United States Patent 12,790,634 (MOST PROBABLE NUMBER ANALYSIS OF HETEROGENOUS POPULATIONS) - sequence listing, part 46

SEQ ID NO: 29 - DNA, 7559983 bp, unidentified (residues 5,669,989-7,559,983 of 7,559,983)
  source 1..7559983: mol_type = genomic DNA; note = Eisenbergiella tayi
gtcaaatgcgcttagatcctccaacgcgcctttgacaaaggttatttgttccaggacaccagcctgccgggccaattccttcgctttatctatcatcggctgcgaaatgtcaaaatgcgtaactttacatccctgttttgcaagaagaatagaaaacctcccgcagcccgctcccccgtcaaacaccgtttttattccgtccagattgtcgagcagtgttttttcaatatggcttttctggataatatcatcgataaacgtttcctcacgatgactttccagctcccctttttcaggcagattccacaaacgctccgatatttttctgctatagtccatataacccctcctgcggctgccgcaagtattcataatcccctcactgccgctcttttcttgctttcagaaaacacagcggcagcagcccttcatataaaattccgtgcttcatgggagaaaagccatgttcggatacaaaggcaatcagctctcccgcattccatttatgatacgtatgaaaaccaataccctccatcatacgcatcctgaatttcggcatcttcccttctatctgtacaaaggtgggagcatacaaaattccgcccggcttcagtacccgcgatatttccgccaacgccttttccggataaggcatgatatgaagagcattggctattaccaccacatcgaagcttgcaggagcataaggcagagccgcagcatcctgtaccgaaaaaaacagcctggaagaatgctccttcttttttgcctcttcaatcatcttttctgagaaatccgtagcttcccaatgtctcacatattgggccagcgcaaaagaaagctgaccggaaccgcatgccagctccagcacatccatatcccggttcagatccggctttatccgcctgcagatattttcataaagcttatggctgtttttcatgaaaggcccgtaaagaaaagccaccttctgccaaaaattaatattcgattcctctttcatgccattccttctttcccctctgcctctatgattgtgtatctatgggaacggcagctactccgacattcataaaaaagctatccagaatttccttattctcctcatacagctctttggaaatcgtacataccacagcatagtatgcataatcaaaccccggcaccgtcagcgctatatattccttaattaaaacatccttattttcatcttctgcttcctgcgtataacgttttcccagaagaccggtatttgttataaaatccgttccctcttcccctgtgggctcctcactgtcaaatccccctgctataatgatttctcctgctgttttcccttctatataaaccttaaagccccattcattgctttccatttcatcgcccgcattcaccttttcataggtactgtatgtccagtcaggaggaagtgtcataaaaagattatccacaaatctatgatgcgtgaatgtatgatcgattacggtctcttcttctacaacgctctgcccattactcataacttccgatgctccgcttcccagacatccggtaaatcctaaaaagcataacagtaatattgccagcaaggctccataatatttacgcaagtcatatcctcccactattcataagtctctcccatattatagcaaataaaaaaagccttgaatacacaagacttttttttcgtaagatttttacatgagcggccttatcgcaaaaaactgagtatccgctttctcgatttccatatccttctcttccgcataattccctcttttttccgggacaaaataatccgtccagccattcttttcctgccccagccaacagatactgtaacgtttttccgccgtatcaagaatcaccgattttattgtgccgaagccctccgcataataatttgctgtcattccctccggatattttttcaacagcagctcccgaagcccgctttccctgatacggttctccgcttcggcaaaagctgtaagcctgtccctcctgactattgaattttccattgccgcaggctcacgggagaccagcttttcaatcacaatatgattcgttccgcataaatactgcttctcatcctccggtccgatgctggtataagccttctccccattcattgtctcaaacaaaattcctgtcccgctgcaatccgccagaaacagattcatgttataagcgattggcatctccatcaccttctccagcgcctctttcgcatccgcgcaattctccagcagacttctgataaccgcccagaactgcagtcctttcagcacaggggcacgcattcccggcaaattgctcacagggaaaccacaggaggtcatggaaactgccagtcccatttcattgatcccctctgtcctgccaaagcccacgatagagccggaaatgtgggcatattttcccgcaggagcggtgcggtacagcttcagatcctcatcctccaagttgaattcataatttcttgctattttcgtatgaccgtcatcggtcttctttcccgttaggatcagaccggaacagcccggcaccagatatgtcatccaggtataagcaatgtcccgtactgctattccggcctcctgtgcatagccttccagttcttcccgaatccccgggcaatacctgtcatataattggaaggcttcctccatttcttttccgccgaacttctccggagccggaatatatatatgattcttctccggctgcttcgccatctgttttcccatttcctgataagtcccttccagttcccaatagcttacctgttgcttttccatatagatccatcctttcttttttaatcctgttaatgaggaagatgaatctattttaaaggcagatgatatattaatcctgtcagttattgcacaaaagtgtccgttaccgccgcattagaaccaaaggcataatacactcaggggcggaaaagtttcaaagcattctctatcctgctcatccctttaatccagtcatagtaatcccttcaataaaatatttctgaccgaacaaaaacactattactaccggaattaatattactgttgccgctgccatcagcagatgccattgtgccgtatactggctggtaaatagctgaagtcccaaagccagtgtaaatttattgtcatcattaatataaataagaggggccagaaaatcattccaggtattcataaaagtaaataaagcaactactaccaaagcaggttttactaatggcaaaataatccggctataaatggtaaaatgaccggcaccatccattaccgccgattcatccagctcccgcggtattccttgaaaaaactgtttgagaagaaatatattgaatgcgcctccgccgaaccaggcaggtattgtcagtggaagatacgtatttatagctccaactttactccatccgataaaagtcggtatcagcgttgccgcatagggaagcatcatagaactgaggatcaatgagaataccagatttctacccttccattcaatccttgaaaaaccatacgcacatattgagctggttaaaagagtccccgccattaccgctgctacaataataatagtattcagaaaatattgtccaaagggcagcagtgtaaaagcctgtttataattttcaagagtaaaaggatccggaatccattccggcggcattctgaaaatctgttctattttcataaaggaacttctgaccagccagtaaaaagggactaaacatattactgctcctgctaacagtatcacagaaacaataatcttcggaatccgttttttctttttcatatccctgttccccctcactcagaatagacccatttatcggatgatcgaaaagttataaatgtcagcactgctataataataaacaaaacccaggaacacgcacaggcacgtgccatctgtgaatttcgaaaagcctcgcggtatagataaaacacatagaaaagacttgcgttattaggtccgccatccgtcataatatatgcctgtgaaaacacttgaaatccattgatcatacccattataagattaaaaaagagcgttggagtcatcaatggaatagttataaatctcattcgcttccagtaacctgctccatccacttttgcagcttcgtataactgcttcggcacatcctgaagcccagccagaaatataaccatagtggagccggttgtccatattcccattaacacaatggatggaattactgttttttcattatagatccattgactctgcggaagtcccaatgatttgagtatgctgttaaaaagaccgaaatcaggattaaacagccaggcccatatcattgatgtcgctaccacaggaacaatagagggaagataaaatatagttctgaatattaccatcccttttatttcactgtttaaaagattagcaataaaaaaagcaactattagaaaagtaggaacactcagcgcaacataatatgccgttacccccagcgctttataaaagaaataatcctccccggaaaagagccgcacataattatccaccccaatcaaaaggggtttgttggaaatcctataatctgtaaaactcaaatacaaactggccgccattggaagcagcgtaaagataagaaatccaagaatagcaggaagggtaaacaatataccctgtacctgatttctccgtttagtaactgaaattccttttttcatttacatcattccccattttcattgataaaataaacggtatatgtctcatctgcaacttcatacagaggtttgaaattaatatttacttcctcctgcgtggttctgaattcccgggtccagcttccccatatccgttcattatgatgcacaagcatattctgtatttgccctctctccccatgaatagtatccttttctgtcattccggccagaacaacaggaccgtgtcggaaggcaatcatctcactgcaccctgacatttcatgaaccgtcagtgcctggtaaaaaaagattgatacttctagttttttgctcccacatggaatatagatacagctgttttccatataataatctacctgttctccattcactaaaagaaccggatccttctgattccaaaaaggaattcttaccaaaacagtcatatctggggcttcacttgcatcaatattcaaataaacagaaaaagcttccggataattgacacttcctgcatttattccaatcagcttttgtacattttttgctgccattcctgattgctgtgttatttttacttttctttcccatctgtcactcgtcagaacggaaggaataaactgatttactgctatttgatttttattctctgcatatattcccattccatgagatgcccccgcttgtatcccgcttccacagcagcaccagaacgatttcttttctgttgaccagattttcctgctccccgcctgcatgggaagataatatgcagcagcacctgtattgggattctgttgtgccagaataccattatacaaattcagttccctgtaattttcaaattctatatccccagtatattgatacaaaaattctgccagacgcatcatattgtatacagcacaatgttcctgatttaattttccaagtctttctctgatatggaaagggggtatccagacttcaccgcttgtctgtcctcccgttacaaaaccccctcttttcgttaccgctatactccaataattttttactgctttcaagtattccggatttccggttacttcatacatcctggcaattccaagtatttccggaattgtagtattggcatgcatattagtcagcacgtccttattttccagcaatgcatgaaaaagcggtctgcgcagaaacttctccatcagtacctggtatttttcttctcctgttatttcatacagcctgcaccattcttcgagtattcccccagtttccgtttccataatgatatccattctgtctgttggtatatcttttacccaacgataaaaccagtctgcaaaatgtcctactatttccaatgctttacagttacccgcatacacgtacatatcaataagacccattatgattttatggagattataaagaggtacaccaaagttcctcccctcttctgtccatctcaactgcttttcaggaattgccccaatccattcccctccgtttgccttttgacaccgctccagttcatccagcatatattctgccctgcccagcaattcacgattaccatctgaagcataagtaatagctgcagcagacaaccaatgacctacaaaatgtcctctgatttcactggtcggcccttcccatccccaatgctctattttaggattttcgctattatccttccacagccccgcttcaaaataataactacgaagcagatccttactctgataacgaagaagtaaatcttcattcacttgaaatcttctgcgaatttcagaatccagaagtcttacctgctgcggttttgctgattcaaatattttattcatgcgacaatacccttccctttatattttataacagtgagggaacaggttttcccctattccctcatgtaactgttattgtccgaataccccgtcaaaaatcttatctacctccggcatgactttatccaaagcatcctgaaccgtttgctcccctgtccatactttatccaatgcaggaaatacaatatcattaatttggttataatgtttcattctatgctcggaagacaattcactgttctcccatacagggttaagaaaaacttccttgtatcctgacggatgtgatttaccttctccggcccactgttctaccttactttcatccgtataccaatcactcttaataggcatccacagaccgctgctatacaactctaaagactctgcaggatcacttaaccatttcatcaattcccatgcttcttccggatattttgtctgtgaaaagataactttacagccactgctggtaagaatcgtattattaccattagaaggcagaggtgcaagtcccagattcagactttccagtttggcaaaattactcagcatatactgagaatctactaccatagcatatttacctgtctgcaaagataaatctgcacttggaagtccctgtgctgttgttgtggaaggactggcatgttctacatttatcaagtccgccaatttctgcaaaaagtccaccgcttcaggatttttcaggccatattccgttccatccttgtctgtgtatccgacagaagtatttcttacaagcaaaggttccacaatcgtaggtcctttcggattaatgtaaacaccatactgctgaatattgcctgcatcgaaatctgcatccaaggcactatttccattgctgtcaaaagtgagttttttagctgtttccacaaattcatcccatgtccaaaccttgtctgcagaaggttcaggcacccctgctttttcaaaaagatccttattataaaatactgcataggtctgcagggaaagcagaagcgcatcaattgcttcatcatcataataagaataagccgcatccagtagatcttccttcttaaaacttgaatcttcttccattaaaggagtcaaatccataatctgtccgtctgcataccagtcatgtgcggtaggcgcaaccaaatatcctacatccggtgctgtgcccgaagcgatcatagtggatatttttgtctcataatcatccggtataaagattccctttacctttattcccgtagcatctgtaaatcctgcaagagcttcttccagcacagccttttctgtagctcctgcccatgcagaaaaagtaagttccacatctgattctgctgcttttgtcttgtctccttcatctgttgaagcttctgacactgattcctgagcagccgtggtatttgtttcttttttttcttccgctgtactgccgcatcctgcagcacaggccgccaataaagttacagtcaaaagtaccgctaatttctttttcataaacatacctacctctctttccatacattcccaatataccccagaaccggttcacaatactgtccacaaatctgttgtgaaaagtatagtaatatggtatcatttcgatgtaatgctaacaactcacaaaccctcaaataaggtggacaatttttagatgaaatactgtatttatcattcttcctatccagtggttttttcttcctgcggcaatcttgtcagtgataatggatttattcatcccaaaagaaatattgattcttttgtattgctccttatccgaaagggtactttatatatcactcaggatgaagatgagtatattcttcacgataatgaatttcttatattattccctcatacacttcactacggtacccggcgcagtgatggttatttatcttattactggacacatttttatatttccgatccttcttatcagatcactgatatatttcattatgaagacagccttttacctttccagaatattctgcaggttctgcagggacatgtggttttgccggaaacaggaaccgtatcatcggcaggacattcccagcttttatttctgcagttaatggatatagcctgtcgtgaacattacaaggatacttataaatgccattatggtttaagcttattattattggagttttgttctgaatcgctttctgcttttatactgcaggacatggacattcctccccgactgtcagagtgtatcgattggatccagcttcactataatcagcctcttaccgcgtcagatattgccaaccgttttaattacaatcctgcttatcttaccagtttatttaaaaaatatactggctacagtctgacacattatatcaaccatgccagaatttccgccgcaaaaaatcttttgacaaatcaggatcagacaatagaagcaatcgcaaaacagtgcggttttaccgataccaagtatttttaccgtatatttaaaaaagaagaacacattacccccagcgaataccgaaatgcctttcatcataaaaaacttgttctttaaactgcaataaaaaaactccggcagaaacctgccggagttaactcttttataaataggaaacctacgtattaagcccctgtaatatccgtcacatgcagataggcatcggaaccacgtgaacagttcacagtaatattttttcctctgattaaaaccttacaattattaagattctttaccgtatcaagcttcagctccatcactccctgaggcgtattcagataaagcatattctggtcggatctgccgtctacggttccggttacggtaatcaccgctgaatcaagcgttaccgaagaagggctgtccttttctcccacgagccccgcagcatgcaggtaagcatccgtaccccgataaaaataaactgttatttttctccccggtgtaagaaccatgcctgaactcgtatccgcgctgtaatcaattacgaactgcatttccccttcattggtggacagatacagaagtgtttcctttgtgctgtccgcaaccgttcctgttaccgacatataagcggaattgttgcccaactgacccgttgccgccgccttatcggaaatcgtcaccgcatgcatataggcgtccgatcctctcgcacaggtaatctcataggtcttgcccaacacgagaaagggaattccactcaggtttgtggtgggatccagcttaatctgcatttctccctgattcgtcttgagatagataagctcttccgtcgtcttgtccccaatcgttcctgatacggtaaccgttgtggaagaatcaagggtagccgtagaagtcggcctgtccgtggttatcttaaccgcgtggagatacgcgtcggaaccgcgggataccgaaacactgacttccttgccgggaagcagtatcttgcatgcactggtatctgttccgctgtccagcttgatctccatatttccctgcttcgtggaaagcctgagaagctccgatgtcgttcccgacaaaatggttccgtaaacagtagcaatgatctcatccgcctgtacttcaagacggtttccgggtactatggtaagccctaatataaggcagagcgtcaaacatagctttgcaattccacactttttcataactgtgcctcctcttatccgtaaaaaacttcacgcaaacgacaattacataaatttatcatataatatttgatatggaaaagcaatacactttcgatatttgcgtcccgtcccggcataatgcgttacacttcatgttttctttttcccccttttatcgtatacttttcatagaaccgccaacgacagcctcagccaggaggtacccatgaatatcagaaagatcataattgccgacgacgaatccatccagcgcaatgtcctttcttccgtcgtccgtaaaattgtccctcctctaacagaaatcgaaatatgtgtaaatggaaaagaagcctttgaaaaaatcagggaaggcggaaccgaccttctaatcacggatatccgtatgcccgtcatggacggcatggaactcatctcactggttgcaagggattttccccaaattaaaattattctgatcagcgcctatcaggaatttgaatatgcaaagagcgctatatcctgcggtgtatccgaatatctggtaaaaccgttccgtatagaggaagtccgccgcctgcttcagaaaatggatgaagaaatcggggaacagcgccagaccacagaaacgcaaaaccaatatgagcatttgcttcatcaattcgaaaaggataaccagcaaaaggctctcgccgctctgctgaacggccaaaaaccgccggaagaactgcaggcattcaataccaatgcactgaaccatccgggtatcaccatattaatccgctggaacatacgtgtacacagtgaaataatctccggtactttttccgcaggccgccgccaaaagtccccggctttactttcaggcctttccgattatcagcaggaacggctgattaaacggctgcatattctcttcccgaatggattttttgttcctcaggaaaaagggatggatgtcagtgaatgccggattgccctgcttctgcccggctgtgataccgatgattcagtcaggttccttaacaaactggcagaagaatgtagttcagagcagcttcttttttgggcggggatttccgccctgcaggacaatcttctttcacgccttccccagtcgctgcagcaggctgaggaggtactctcttattacttttattatcccgctgaatgcggtatcttttcatatgctgatatgaatgaattatttgaacttcccatgatttccatctccggttatgaaactgccatccgggaggccgttcataccggactggacagccagttgtcgaaatgcctggcggatctgaaaaaagaacttttaaaggatcccctcaaatatcctattaaagtgaaacaccggatatcttctatgattgtatccattgtcagagatttggacggtatgatcacacagcaggcctatgatgaactgctaaatgaagcctaccatctctatggaggctgcagcacttttgaacagctcttctccatctctctggagcttcttaaacgcagctgcgcttatttcacgcaggaaagcggacagtatgacgcggttgaagatattattgcctatgtcaaaaagcattacacagaagatatttccctttccatgctggcggatcgcgtccatttttccgccaactacctttccatgcagatcaaaaagaagacaggcatgagttatgtcagctatctcacacagctgcggacggaacgcgcctgtaaactgcttgtggaaacagaccgcaaggtggcggatatcggcacagaatgcggttaccgggattccagctatttcaaccggattttctgccgtaagttcggcctgtctccggagcaatacagaaaggtacataaaaaatgttgaaaaaagtaaccaatcgaatttactcctggggcttccaggaacggctgactattattttaatcctgtttgcgctgattcctcttctgatcatccagcagatgatgatgcatttttatgaaaaccatatcattgcagaggcttccaacagtaccctttctgtggtaaaggccaacaataatgtgctggaaatgtttatggacggcgtggaaaccacctctcagctgatgattgacagtgaattttactatgatatcttctcaaattttaaggatatgagcatcggtgactgcctgcggagtgaccgtgttatttccgcagaaatggccaagcagttttccgcacaggatgagatatacgaagcatatctttatacctccaaatggattttcggcaaggataccggtctcatgaccacatccattgaaggcgcgcagactgcggggtttataagcgccgctaatcagtccaacggccttccccgctggatcaccggctatgattacggcaaaagtatcggttcttcctatctgatgcagaaagaatcctatgcctggaaatatccgctcaccatggtaagacagatgaatttccagtattcctccacaggttcctatcagaaattatcctccgacgcggaaaaaccggttttagttgtacatattctggagaactccgtcagggaactgtacgcaggcagcatcagctatgagggcagtctctacgctgtcgccaattccgacggcaccattatatcctccgacaatgaaaaattcccggtaggcagccatacccaggaagaaatcttcactcatttcggggaatcgggatatctttcctgcagactggatcaggttccctatctgctctgctatgatactatttctgaaaagggactgctttctttcgcctttgtgcccatggatattctcatgaaaaatacggttgcaaagacacggcagctgcagtttatctgtgttatttccctgattctgctttccgtactggtagcctttttgctttcccggacaatcaccaaaccgatcaatgccctgattacagcttcacgacgggtggccggaggtaatttcagcgccgacacaccggttccccatggaagggatttcaagctgcttacggaaagctttaaccatatggaaacacagattgaccggctgattcatgaaaactacgagatttccctgcgtgaaaaggaaacccagctgatggctctttccatgcagattaatccgcattttctctataacacactgaataccataaatatgcttgccatccagaataacgatgaggaaacctcggagctgattgtggatctttccgagatgctgcagtatacctttaaaaacacttccgaaaaatgcaccctggctgatgaaatcgcctgggtttccaactatctcgatatcatgtccaggcgctatgacaacgtgtttgtaacgcgcatggatattgaggaagagctggtggactgcagggttcccaaatttcttctgcagcctctggtggaaaattccattctccatggattttcccaaagacaggaaggaggcattctgacaatccgtattaccagacaggaggaagatatgatcatactggtctccgacaacggaaagggtatggacgaggcccagctggagaactatacggattcgctcgccagggacggccatgtaggtatttccaacatccaccgccgcctctcccttctctacggagaacactataaaatccaggtgaaatcagagccggaaaaaggaacccggattactatccggattccctgcgaattttccgtataatatggcatggatacagaagcctaatgtaccagaaaccatgtagtcatttcagttattcccctgtttgcccatgcaaaatagggaatcaaacggagcggtatttcctcttcttccgccggatgctccgtgtaaagtccgtcaaagggccggcgcacaaaagctttcccataaaatactggcaccgaaatcccttccagcgcctccattctcttttcaaactgtacgccgcggtcaatcctgatatcctttaacggacggtccgcatgatccatcccttccgcgcataacacacatgggccatacataaccgcagctcttccgcaggcgtcaatcacctttggatttgcttccgccagcctcgtttccatactatatttaagttgaagagaatctcccgctttccagtcccgttccacacaggcataccccttttccagcctgaattccgctttacagccgttcaccagaatatcgtatttcctgcaccatccaggtatgcgtgccgcgatggtatatctgccttccgtttccgtaattatcgtcacatcgccctcatagggataggccgtcatctgttttaaacgaactggcccgtccgaaagcatcagctctgtttccgcttccatataacaatgagcatatatgatattgcccgatacggaatacatataatcggcaatagaaccaaccatccgcagtaaattgggcggacagcaggaacagtcaaaggactttactcttttcagaatcggcagatgctccttcagcccgtccggcctggattcattaaaggcgttccttccgggattcacggaaaccggattttcataaaagaattcgtcccctgacaaagagacgccgctcagtgcggtattatacagagcacgttctgcacaatccgcatatctgctgtcagcatccatcagccacatccgcctgcaaaacagcgccagggcgatcgaagcgcaggtttcattataagcggtgtattccggcagatcataatcaaaggtaaatgattccccacggtatgtactgcccacgccgccggttatgtacatcctccgttctgttatattttcaaaaagctgcctgcagatatcacccagtttttcttccttggtacttctggccaaatccgccatgccgctatacaagtataaagcccggacgcagtgcccttccgccgtattctgcattcttaccggcttatgggactgcatatgctcctgatccgtgaaatcataagtttcatcccgttcactggtcccccttgtattaataaagtattctgccagcagccggtaacgctcctccttcgtatagtcgtacaatttcatcaaagccaattcaatttcctcatgaccgggggtatcaaaggccgccgaatgctccacacgaaatacccggtcaatgagatccgcatactttacagcaacctccagcatggctttctttccggtagcttccgcataagcaatcgccccttcaatcaggtgtcccgcacagtaaagctcgtgatccgtccgccttgtaaatcgtgcctccggttccaccaccgtaaaatacgcattcagatacccattatcctcctgggtccgcgccatatacgaaaccagttcatccaccctcgcttccagctcaggatctcttttcttctgcagaaaatatgccgctccctcaatccacttagtcacatccgactcccagaatatatgaggcttgtaaggcattccctccctccagttcatcttcatggcttcaaaccggcctgtttctttaaacctgtcataaagcgcatccaccgtcacagcacgaaataaatcctgcctctgcttccagaaaccgccggtaatattactattcataaagcttaccggttctcctgtaaatcttcccatttctttcctccttctgtcccattacagacattttcctaatatatcctgatatctatgccttcagccctgtcagggagattccttcaatcaaatgcttctgcccaaaaagataaatagcaacacatggagctaccacaatagtagacgcagccatcagcagattccatttcgtggaataatcccccttaaactgcagcagcccgatagccagcgtaaaatgctccttggaattcagataaataatcggtccgaagaaatcattccaattatttaaaaaggtaaataaagccaccaccaccagcgcggatttggaaagcggcagaatcaccctcaggaaaatctgaaagggccctgccccgtctatccgcgccgcttcatccagttctcttggtatccccaggaaaaactgacgcagcagaaaaatattaaaggctccgcctccgaaaaaagacggcagaatcaacggccaataggtatccaccagattcaggtttctccaaatcataaactgagggatcagagtaacagaacccggcagcatcatggttgttaaaatcagggcaaagcaggcgctccgccctttccatttcactctggaaaaagcatatgccgccatggaagccgtgaccagcgtaccgaccatacagccgcctaccactatcagcgtattgacagcatatctgccgaaattggccgccttcattgcatctgtataattgctccataacatttccttcggccagaaaacaaaaggccgcatactgtaaatgtctgtatttttcataaaggaagaacgtaccatccagtaaagcggaattacgcagacaaaagccagaagaatgagcacgccgtaaaaacaaaatttttttacataataaacggcatttttctttctcctcatgactcgtcccctccttcataatacacccatttatttgatgtcttaaataccaccgccgtcaatataagaaccactacaaataaaatccaggccatagcggatgcttttcccatatccatatatttaaaagcctgccgccatagattatagacatagaacaaagaagcattattcggtccgccttccgtaataatataggcctgggcaaatacctgaagcgcattgataattcccatcaccagattaaaaaacagggtggaagataccatgggcagcgtaacattccagaatttatgccaggaatttccgccgtcaatttccaacgcttcataatatacctttggaatatcctggagacctgccagaaaaatgacctgggtggaacccgtcgaccagatacccataaacacaatggatggcagcacacttcccctcccccagaagaactggctcttcggaagatgaagcagttccagcagagtattgaataatccgaaatccggattcatcagaagaagccatacgaagctggtagccactgccggcagaatacagggaagataaaacagagaacggaaaaaagcgcgtcccttcatctcacaattcaaaagcagggctatcataaaggcgaaaatcaaatttgccggtaccgccataatcgcatacaaaatagtggctttggcagacagccagaaggttttctcctgcccgctgaataacaccacataatttttaattcccacccaggacggtgaaccgataatattataatcacaaagactgtaatatccgcttaacgccatgggcatgaggttaaaaatcagaaatcccagtactgccggaagagcgaaagaccagccgacaatattgttccatgttgacattctgattgttttcttttctttcatgtttccacgtccttcctgtccttaaaaagggctgccgtaccttgcacggcagcgccttataccgctgcttatttaccgtagaatccctgtacctgtgcattggcatcctcttctatggaagagatcgcctcctctgcagtcttctctcctgaccacaaatcatccagcgcaggagtaattacatcattaatcttgttaaaattctttacataaaccggcgcaggtgttcctgccgttccgtctatcatcggttttactatggattcataataattggccgggtgcttatccgtaattacagatttgatataatcctcactgtactccttcatattggtaggaagccacagaccggacttgaataacggctcacacgccccctgctcggtaagcatgaatttgataaattcgaaggcagcatccgctttcggcgtattcatcaaagcaatcgcaccatacgttgcaaccgttctggcctcatccgccatcttcggcagcgccgccacattatattccacatcatcatccatcagagtcgcgttcgtccactgcccgtcaaagctcattgccactttgttggttgccaacgcttcagacagaccaggcatagtatccccagccgtcggtgtgggtgccacatgatagagatacgtcaaatccgcaagcttctgaagcacttctttcccttccggtgtcgcataaccgatggaagttccgtcttccgacagataatcctgaccaaatcccagcataaacggcagatatcctgcccaccattttgaaatagtcacaccataaatatcgatattatccggatcaaatgcaggatctaacgcatttttaccatttttatcaatggtcagcctctgtgccacattgacaaaggtatcccagtcccaggcatccgcataactggccggcggttcctctaccccatattcttcaaacagggccggattgtaaaacatacagatattttcagaacccacgccatatcctgcaaaataatccgcattcagcatgaatttgaattgatccccgatacaatcctgatcaaagctttcatccttatcaatgtaatcctgcatattcagaataattccttcttccgcgagcgggaaaagaagagtatccccattcatacagcaaacctcaggtgtatcatttcctgctaccattgctgtgatttttgtatcatattcatctggaatattcataactgtcacatggatattggggtgtgaagcattaaatttttcagcgatttcttcatataccgccaacgtattgcctccgtcccattctgtaaaacggatttcaaccacctcaccgctgctgctgctctcctccacattgcctgctgccgcgctttcctgcgtggaaatgtttgttgtactgccgcatcctgctgttgaaacagccatcataccggccataaacaatgctgccgctctttttgccttcattttcatatctcccttctgccgttatacggcttccctttttgtatttttaatataccagtcctgcgcggcggcttccattggacaattccttaaaaattggacaaatcaatactctttcatcaaagaaagcattccctgctttgtttttctgtgatcgaacaggaggcaggtatttatattacctgcctcctgcatgccacactgtttcctacaacatgacacttttattttcccggattattattcatcaaagctgataacagccttccataacacataatttctgtctgttaatctattacccttttccggatgcgtaattaacctttaaccgccccaatcataacacctttcacaaaatatttctgtacaaacggatatatacacaaaacaggaaccgttgtcagtatgattgtggaatacttaatagattccgcaaactgatttacctgatcgttttccgccgcagccgaattaagcacattggaatttgcgatcaggattgccctcatgatgttctggatcggcagcttactgttatcctgcaaatagatagacgcattgaaccaggaattccagtgtcccacgccgtaatacagcagaagaaccgccagtgtcggcttaatcagcggtgccacaatccggaacagaattaccagatcattcgccccgtctatatatgccgattccatcagggaatccggcataccctctattgccgttttgcatatgatcgaattataaacactcacagccccgggcagaatcagtgcaaacagggaattgtacaatcccaggctccgtatattcagatacgaaggaatcatacctcccgaaaaaaacatcgtaaacaaaatcaggaactggattgcaggcttgaacatcaccttctttgctgccataaaatatcctgtaaacagcgtaagcagaatattgagcggaagggatacgaacagcactatcagaatattcttatatcccgaaatcagaagaggatgcgtcagcgccagcttatatgctcccaaagtaaattcatggggccacagtatcatccccggatgggaaatcagatatgtattggatgtaaacgacgcacacagcacataccagataggatacagtgtcacaacgcacagcagtaacaggataactacattcactccggaaaatatcctgtctccccgggattccctgctcttcagccgtttggaattgtttttattcatgtcattatttcctccctatcagaacaggctggattccgtagatctcttgcttatggcatttgtcaccagcaaaaagactacattgaccagcgtattaaacagaccgatggcggttgatttggaatacataggcgtaccgctggtgggaaaagacaaacgataagtataggtagaaataacatctgccacatcataagtcgatgcattataaagcagaaggattttctcatagcctacattcagaatattacccatacgcaggataaaaaggatcataatggtcggcagcagaccgggcagagtgatatgcagcatctgccggaaccggttggccccgtccacacgtgccgcctcatactgctcctggtcaatggcagacagcgccgccagataaatgatggaatcccatcctatcttctgccagatatcagataccacataaatggtccggaaatatcccggatttacaagatagttctccgccgttccgcctaagctgactgcgatctgtccgaaaagtccgtcctgcatacaaaaaatcttcaccatcgcacaaagaaccaccatggagataaaatatggcatatatgtaattgtctgtaccgtcctcttgaaagtcctgtttcgaacctcattgataaggagtgccagaaggatcggagcaggaaaactgaaaacaattgtcagtccgctcagcaggaaggtattcttaatcacacgcgggaaataaggatctgtcacgaaatttacaaaccacttataccacggattcgcccaagaggagccctggatcccccgtgtaattttgtaatccttgaaagcgatgatcaggccgtacatcggtttatagcaaaacaaggccagataaacaagaacagggataattattacatacttccatttattcatgttccagtccctgatcagcctttttttgagcgtaccggcaccgccttttacagcatctgtattcatatctttctcctttcaaagcgcataaagccgaacagcagtggaagacatgcgcctttcactgctgccacgggctcataagctttagttaacgctctacataccggtcatagcaggcctgacgaatctcaagcacgcgggataaatgataggtctccaaatcagcaagatacttttcccatacggcatcatcattgatatccttggatcccgtaaggaattccgcatatttttcttccacaaaggtagggatattctgtgctatttcatccagctcgtccgcctcttccgtggtaaatgtaacccctataggccatttccagccactggtaaccgccagattcttttcctcatcatccggatatacataataccatgtgttgttggcttcaatcgccgcctcgctgttcttcagatacagcaggttcgtagcctgaattccgggagcaccccaggtaaggccgttatatttcgtcatcgggtcggtgtccttgtcatccgtaacaagactggtaaaggccggaacgccctgatcgtcatattcccaggaaacgccctccgtcccgtaattccagtacagagaaccttccttggtataggaataattcagcatctgaaggcacagtttcatcgtctcctcatcagccgcagtagtgataaccgccgtatgcgttccaataccagggcctccgaatatagacgacagctccccgctgtccgatttgggataagggattccaatccataccgcttccttgccgtctgcctcacgttccgaattccagatattcatctgccccatggacgtaattgatataccgcatttgtcattgtggatcttatctttgattgtggtatcatcctccgtcagaatatcctgatcaatcagcccgtctttccacagcttattctgccagatcatataatcccgccattccttctccgactgtccaaggccgacaacgccgtcctttacgtaccagccgtttcctgcatccgcattcccatacgcaccaaacgcaccggcaatcccctgcgctttatatcttaccgaataggatgaattaaaggttgcgccatatttctcatggaacacacgaatcacattttcaaactcggaaacggtttcaggtatctccaagccgcattccttcagccagtcctcacggaccacaggcccctggtagctgtcattccagcctccgtcctccctgaaaaatccgaacgcataataccgtccgtcatccgttttcatcgcccgatcataggccggatctgtctgaagccaggcgtaataatccggagcatattcctgaatataatctgtcagatcccagataatgccgtcctctatatactgattggcattgttcatccaataaacgttcataatatccggcagattggtcggatctgccagcagagtcgtcgtaaacgtagtcccgtcggaaccggttgtcggaaacatccattctatgtccactcccagcttttctgccagcccgatatggaacggtgactcggatgcatcggcaaatttctcatgaggcactatattgtcctgtgcataccagcggacctttttatcgctgttcagcgggtaggtaatgcttcccgcttccgctgatacggcttctttcccaccttcagactcccccgaagtttctccctgcggcgcggacgttgctccgctttctttttcccctgtactgctcccgcagcccgcctgggacagcagcaaaactgccgacagccccaatgccaggattgatgtaactctttttttcatgtaaccctctccttttcaactttgttttattaattcaacggagtatcaaaaacctgagtaccggcaggcttcctgattcctctgctaaatttcttcataccgccatccgttaaactgttcctgcagcatagttttatacgtattacgcatattttaagcaaaaaaaatttccttcgctttctcaggagacagttccagtgcagatgccagctccaccattatatccattgcaggtaactgtttcccattaagcaccagcaggagttcccttttatttatcctgcttctttcagaaagctcttctacggatcgaatccctctccgttccatttctgatttcaatatattcaaatcgaccatatacttcattcgcatctttccttgcttaaaattatacttaataggcatatttataataacactatattccataaaatgtcaatcagtcctatacgattatatcctttattttatttgtatttttgttcaccatatttccctgttttggacgatactctgttttgaacattcattgattgatataccattttatgatatatttactatgtatccaatattacatgacatatatgacaatactattaaacaggtgataactcatgaatccgaacccctacgaaatcttccggtcacgtatgaaagaacgcagaacaatattaaatataaccctgaccgagatagctgaagctttagacatcacgcagccgacagtccagagatatgaaagcggtgaaatcaaaaatattccctatgataagctggttatgcttgcagatcttcttcaatgtacgcctccttatctgctgggatgggagtctgaaacgaattcacctccggaaattccaggagaagaagaacgcatgctccattatttcaggaaattaaatgctaaagggaaaaaagaggctgtacggcaaatagaaaatttaactcttatttctaaatacagcggttcttcagagaactaagaaagggacaaaaagcaggggcatcaatacccattaaccaaggtattgatgcctccttttcaggaccgtactattttattttaagccaagatatttttcaatttccggccctaaacaacattccccctatttatccggcgatgccacatataaattaaacatccagtcatgagtactcttgagctccggatgacgcgtctcctccaaaatttttttatgcacgttgaaatatacgtcacgccgtccatcccccagcagcttgcggactttcttttgaagcggaatatcctcgtccagcaaatctgtaacagctcccgaatatcttgtatcccgtcccgcccgtagttctttcataaccgtatcaaaatccttcgcctgcgtataattccgccccagatgatctgtggccgcatccaggctgtcacagatcgtaatgatatcaataaagattttgataggggatactgtattatcaaaatcggcaggatatcccgattttccgtcaaaactcttctgatgcccaagggcaatatcacggaaaatagaaagctgcggcagattttgcagcatctcccctcctgtctgcggatggaacctgagcacctgaaattccaaatcaccgagccggtggctctgggcattaataacactggagcataacaattttccgatatcatgcagcaatgcaccctgatacaggaatagcagaaactcctttttcttttcccgtacctcttccacgctgtgtgttcccaactgccctataagaagctccggcttatgctctatcatgctctccagtatatccacagcaagataccctaccatatacgaatggattgcggtctgcacctgacggaacatcgtcagcttcagaagagaattcagaagcatttccttatcccttgcatgaggcaatgctgtctggatataacaatagctgcaggttccgcagacataatcgacaaaggttgtataagccctgtcgaaaaaatattctgtaaatagccgcagggtcctgtcaaaaagctcctcgtctgttttacctctgtgcgtaatattctcgaccgccagttctattccctccatcgcctcaagggaatgctggctgaaagtaccgccctccgtaaacaaaacagaaatgaagctctggtccatcaattcatgcagtccatccataacctccttatctgaaataagccccgacagtctcatcgccatatgataaacaagaccggttctcacccgatagcactcagagtgccccgtctccttctcacttgtttcctgccttctccgtgccgccgccagaatcgcagcgcattgctcctgcgtacattctccgggagacaggcaaagagcacaaaagcccagataataatcaaagtcaggcaaaagaagattaaattcatatccctgatcaacagcgactacataatccaatgccttttgactgactctgtggatttccaccatttcctcaatcaacgcagatgatatgtctcccagcttcagacgatttgacagcctgtcaaattccaaatcataaatagacaatcccatactctgttcttccggtgtaagtctcaaaaattctctctcatatattatacttgccctggcacagtcctctttcacctgctcttccaaatggatcccatccaggaaatcgcagcagaaagcccttgcaagcaggcatttcatcaccgccacatcatctccaagtccctcatagaattccagcagagactgcgccagctcacaggccgtccccaaatcctgaatacgggtgatatagcggaacataaaactgataagcggatccgccacctgtcttgtccatctttccttaccccttgtaaaacagcgtacatgcctgtccagcatctcttcattcttccgatatgcttcccgtatcgccgcagaatttttcatatattcttcgatccaatcctccgcggacaaatcactttggaccagtttataacttgtatcgttaagcttccatatctccgtattataatccgtaaagaattgtgtccattcttctctgctgtaaaaaccatgggactcttcctgcatgtaaaatgcctccctccaaaacctcatacctaaccttattctattataggctcgttaaagatttggaacaagcccaacttatcctcacaaaacaaaaggctctcaatcccttatcatcaggattgaaagccttcttactctttgcagccaggtaaaacagtacaaagagtattcagtataacaccaaatgccggcaaccggacttgaaccggtacgagattgctcccgagggattttaagtcccttgcgtctgccaattccgccatgccggcgaagcttacgccagataaaaagataagcaccgtcatgcagacaatgcctcttgtttcttcttttcacaattgtaaaaagaaacgacccagatcggactcgaaccgacgacctccgccgtgacagggcggcgctctaaccaactgagccactgggccaaaaaactatgtaactaatggaccttcggggactcgaacccaggaccgaccggttatgagccggttgctctaaccaactgagctaaaggtccgtaatttattacggaaaacatcctgatattcaggataaagccgatgatcggactcgaaccgataacctgctgattacaaatcagctgctctgccaattgagccacatcggcatataaattactcagtaaatcttttaacaactaaaaacgcatcggttattatcactgctgcgttttgactattaatgactccgacgggaatcgaacccgtgttaccgccgtgaaagggcgatgtcttaaccgcttgaccacggagcctcttttcttttccaggttccttcccctggctccacgcttctcccagcgctctttcactcctcaggactcagccttcacagctaactccccgagtagggctcgaacctacaacaactcggttaacagccgagtgctctaccattgagctatcgaggattacttcttaccacttctctttcatcacttatatgaacccataccctcaaaaccgaacattgaatctaatctctttctccaaaacttactttcccataccttcaggataagccctcgaccgattagtactggtcagctacatacattactgcacttccacctccagcctatctacctcatactctctaaggggtcttacttattgggatatctcatcttgaggggggcttcacgcttagatgccttcagcgtttatccctgccggacttggctactctgccatggctttggtagccaacagattcaccagcggtccgtccatcccggtcctctcgtactaaggacagctcctctcaaatatccttcgcctgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagtcctactttcgtacctgctccacccgtcggtgtcacagtcaagctcccttatgcctttgcactcttcggatggtttccaaccatcctgagggaacctttgagcgcctccgataccctttcggaggcgaccgccccagtcaaactccccgccagacattgtcccccgcccgggtcacgggcgcaggttagaaacccaatgctgcaagagtggtatcccaacagtgactccatgattactggcgtaatcacttcttagtctcccacctatcctgtacatacagcatcgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcggagcttcgttgcctgactcctcctcttaaccttccagcaccgggcaggcgtcagcccatatacctcacctttcggtttcgcatagacctgtgtttttgctaaacagttgcttgagcctattctctgcggcctcctttcagaggcaccccttctcccgaagttacggggtcattttgccgagttccttaacaatgcttctcccgccggccttaggattctctcctcatccacctgtgtcggtttacggtacgggtatcatatgaacaatagcggcttttctcgacagctggctcacctgcttccctacttgaattcggtacgcgtcacgccttcggattgccggacggatttgccagtccggctcctacttcgcttgcaccgggtttccctttcccggctcaggctttccctctgtgtccccacagttctgtcatatgatagtacaggaatctcaacctgttgtccatcggctacgtctttcgacctcgccttaggccccgacttacccagggcagatcagctttaccctggaaaccttagatattcggcctggaggattctcacctccatctcgctactcattccggcattctctcttcttaccagtccacaataccttacaatactgcttcttcccggtaagaatgctcctctaccaacgtgattactcacattcctaagcttcggtgtcgtgtttcagccccggacattttcggcgcaggacctctcgactagtgagctattacgcactctttgaatgtatggctgcttctaagccaacatcctagttgtctctgaaatcccacatccttttccacttaacacgtactttgggaccttagctgtaggtctgggctctttcccttttgactgcccaacttatctcgtgcagtctgactcccgtacagcattcctatggcattcggagtttgatattcttcggtagactttgacgccccctaggaaattcagtgctctacctccatggaattaatacgaggctagccctaaagctatttcgaggagaaccagctatctccgggttcgattggaatttctcccctatccacacctcatcgccacccttttcaacggatgtgcgttcggtcctccattgccttttacggcaacttcaacctggacatggatagatcacccggtttcgggtctgcagatactgactgattcgcgctgttaacactcggtttcccttcggctccgtcccttaaggacttaaccttgccagcacccacaactcgccggaccgttctacaaaaagtacgcggttgtactctacagtacttccacagcttgtaaacacaaggtttcaggttctctttcactcccctcccggggtccttttcacctttccttcacagtactatgcgctatcggtcactaaggagtatttagccttacggggtggtccccgcttattcccacaaggtttctcgtgtctcgtggtactctggatcctgctgtccaaacttggttttcgcttacggggctttcaccctctctggccggtctttccaggaccgttctgctaaccgcatctgtaacgtatgcagtccgaaccccagcatgcacgcacgctggtttgggctcttccgttttcgctcgccgctactcacagaatcgatatattttctttctcttcctccggctacttagatgtttcagttcaccgggttccccccgcatccctatggattcagaatacggtgacggaggtttgctccgccgggtttccccattcagacatctgcgggtcaaaggatatttgctcctcaccgcagcttttcgcagcttatcacgtctttcatcggctcttagtgccaaggcatccaccttgtgctctttacagcttaacctgtttgtaactcgtccttacttggtctcgttacggcatacatagcgttgtatgctctttttggtatttcttcctattctttcgaataggttattgcttgttttggatgtcttctcgtttatcttcttctatccggttggttcctttcgaaaccttccttttagacgttgatactttaagattattttcaatattcggttttcaaggtacggattcttttctttggatgtttccatccagtggagacggagagattcgaactcttgaccccctgcttgcaaggcaggtgctctcccaactgagctacgcccccatataatctggcagccacctgctctcccataccgtttccagcatagtaccatcggccgcttaagtcttaaccatcgtgttcgggatgagaacgggtgtctcccctaagcgtatcgccaccagaatcttttttcctgatgttcccagagccttccggctcccttaacatctaaacagtaatacaacccctacttcttcgccttagaaaggaggtgatccagccgcaccttccgatacggctaccttgttacgacttcaccccagttatcagacctgccttcggctgctcctccctttcggttaggtcacagacttcgggcatttccaactcccatggtgtgacgggcggtgtgtacaagacccgggaacgtattcaccgcgacatgctgattcgcgattactagcgattccagcttcatgtagtcgagttgcagactacaatccgaactgagacgttatttctgggatttgctccacatcactgtctcgcttccctttgtttacgccattgtagcacgtgtgtagcccaaatcataaggggcatgatgatttgacgtcatccccgccttcctccgggttatccccggcagtctccttagagtgcccagctttacctgctggctactaagaataagggttgcgctcgttgcgggacttaacccaacatctcacgacacgagctgacgacaaccatgcaccacctgtctccaatgccccgaagggaacacctctttacaggtgcgtcattgggatgtcaagacttggtaaggttcttcgcgttgcttcgaattaaaccacatgctccaccgcttgtgcgggtccccgtcaattcctttgagtttcattcttgcgaacgtactccccaggtggattgcttattgcgttagctgcggcaccgatgggtccatacccacctacacctagcaatcatcgtttaccgcgtggactaccagggtatctaatcctgtttgctccccacgctttcgagcctcaacgtcagttacagtccagtaagccgccttcgccactggtgttcctcctaatatctacgcatttcaccgctacactaggaattccgcttacctctcctgcactccagcctggcagttccaaatgcaatcccaaggttgagccctgggttttcacatctggcttgccatgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcaccctctcaggccggctactgatcgtcgctttggtaggccgttaccctgccaactggctaatcagacgcgggaccatcctgtaccaccggagtttttcacacggaaccatgcggttccgtgcgcttatgcggtattagcacctatttctaagtgttatcccccggtacagggcaggtttcccacgcgttactcacccgtccgccactaagttataccgattccatccgaaaacttcctccgtgtaacttcgttcgacttgcatgtgttaggcacgccgccagcgttcatcctgagccaggatcaaactctcttgtttaagtgtttaatccggttaagattaactctagctaatgtttaaccgtttgtttgtttccaaacatttcttactgtttttgggtgtcttaaaggtcttctctcgaagctttaaaacttgttctctgaattttcttttttagaattttcagggttgcattactgtttatttgtcaaggttctgtgcttgcgattccttatctgatgtttgttcccagacagacctcacaagcttgcacagtaacttcttatatagaagaactgcgaacggagaaggagggatttgaaccctcgcgccgctattaacgacctgcaccctttccaggggtgtcccttcggccacttgggtacttctccaagcaagctgattcaatcaactctgcggtttgacccgctatttatttttgtgtgtctcgaaaatcattcagtctgatttccgcagcgattaacgctaacggagagggtgggattcgaacccacgcgcccttgcggacaaacggttttcaagaccgcctcgttatgaccacttcgatacctctccatatgttttctgtcaaacaaaacactgggatattctgtatcttatcttccctgctgtttataggaaagaatgttttcaagctttgctgttgcggaactctccgtttgttcagatgtttgtgttcctcagcagtgcaaaagttattatagcgaaaaaggccctcagtgtcaacacattttttccaatatttttaattattttttagaaagtgtaatttttcccgtatttactgcatatacaggaatagcaaatcggtcagattttgcaaaatcagactcttttttccaaaatgccgtcagcaattacaagatcttcgggcgtggtgatcttaatattttcataggatgcccggaacaattttacgggttggtgaagcagggtttccactgccatggcatcatccgtgatctgaattccctctgtacgcagcttttcttcttccttgataagcctgcggtatgcctcccggatcagggacgcctgaaatacctggggggtctgcatcatccagacgagatcccttctgggggttgaaactgcaaaatcctgatcgtctgcgatttttatcgtatcctttaccggcatcgccgccacacaggctttgtgaacccgtacattctccagtgcgtcatttatgatctgcccggtaacaaaaggtctggctccgtcatggataaatatataggcacagtcttccgatacagcctccagtccattggccacactgaaataccgttccgttccgcctgcggttatatgctttaccttggtaaggtgatatttatcgactatttctttccgacagtattcctcttcccctttttcggttaccaggatgatttcatccacgaagctgtcctgaaatgtctgcagggaataataaagaaccggcttttcccgaagcagcataaactgtttcggcacatcgctgttcattctttttcctttaccggcggccaatactaccgcagctgttttctcctgcataatctgttcctctttttctgcatgggaagtaaatttcctcatgctctatgtataatgcaggcgtcagaatctatattctttcacccagcttcagattgggaaccgcattcagatcccagccatgtcttgttcctttgcagtattcataataaccggccacgccgatcatggcggcattatccgtacagtagaccggagatggatgatagaattccaggcctttatctctgcaggctttttcaaatgcggcacgcagagaggtattggaagccactcctcccgcaatggcaaacttattcagatggtattgggacacggcttccatggaatgccctaccagaacatcgatcaccgctttttggaaagaagctgcaacatccgcctgatttacttcaattcctttcatttcacaggaattgaggtaattaagcactgcggatttcaggccgctgaagctgaaatcgtaggtactcccgtctactttcgcacgcgggaatacaatggcatccggattgccttcttttgataccttatcgattttgggaccgccgggatagccgagcccgatagccctcgccaccttgtcgaaggcttcacccgcggcatcatcccttgttcttccgatgatttcgtactccccgtaatcttttaccactacaagatgggaatgtccgccggaaaccacaaggcagataaaaggaggctccagatccatattttcaataaaattggcgctgatatgtccttcgatatgatggactccgaccaaaggcttgtccgcggcaaacgctatggcctttgctgcggatactcctaccagaagcgcccccaccaggccggggccataggtcaccgccacggcagtcacttcctctaaagtaatacctgcgtcggacagggccttttcgattacctgatttactttctctatatgctttctggatgcgatttccgggaccacaccgccatagagcgtatgcagatcaatctgtgaatatataatattggaaagaacctccctgccatttctgacaacggaggccgctgtttcatcgcatgagctttccactgcgagaatatagatatcttctttttccatgggcttttctccattattctgctgcatatcagtcttcctcgaaaaggaggtctatacttttcccgtctttcccggcaatggcctgagggaagattttgcggactccatccatataatcttccggcctgatgagggaaggactgtaatgggtcagccacatctgcttgacctgggcgcgttttgccatatccgccgcttccaggaaggtcatgtgcttgtattcccgggccttgtcctttttttccggttcgccgtacatgccctcgcaaatgaacagatcggcttcggcggcattttttacgattccctccgtgggcctggtatctgtacaataggtgagcttaattccttttctgggaggccccataaccatatccggggtgaacacgttttccggggtctcgatggtttcccctttctgcagacggctccaatactgtttggggatattcaatgcctgggctttgtccaattggaaacggccgcttcgttcaatgattatactatagccgtagcagactacattatggttcacgcggaaggcttcaatacggaagccttcaaaatctatgctgtgctccggctctgtcagttccatatattcaataggaaaaggaagttcgggagcgatgacacgaagggaatttaccacacgggtaagccccttggggcctatcagaagaagcggttctgtccgttctgcattccccatggtgagaagcattcccggaaggccgctgatatggtcggcgtgataatgggtaaagcagataatatccaccggcttagggctccagcccttttccttcatggcaatctgtgttccctcgccgcagtcgatcataatactttttccattgtaacgggccatgagggaggtcagccacctgtagggcaggggcatcatccctccggttcccaataaacatacatccagcatctatacgtattactccaatccgctacagaagttcttttgcctccttcacttcggcaggcacctgaaattctgcgagcattttatcaaaacactgttcgcacaggtcaaattgatacacctgtccgtccttttcactgaaatatccgaaagcatggctgacttcaaaacagccttccttcagtattccattttccacctttaactcttttttgcatcggttgcagattaccgttacaagttgggtattattatcctgatatttccgcatggccactcctatccgcgtattttacgctttccgttttgttcattataacgtaaatttttgtcgaaaaacagcggtaattattccatgcgctggctatctcttccacataatgagcgcattttcattcggatttctgtaaaaatttttcctgattccctctgtaacaaagcctaaagactcataaagacggatagcgggcagattactctcccgaacctccaatgtaaaattttccacgccggaggccgccgatttctgcatcaattcccggagcagaagacgcgcgaatcctttttttctgtatctttcgtccacggctacattggtgatatctccgtcttcaaaggatctccagataccgcagtaggctatcagtccttcctcctctacaatacaggaaaggtagagcgcattctcatcctccagggcatcagcgaaggcctgcatcgaccaggcatccgccccaaagcatttttcttccagcgcggcagcctgagtaagatcttcccttctcattctgcgaatttccattatcagccaccactttcttccgggatggctttcttctctttggagaaggttccttttctcatcatggcgtcaccggcctgggctcctgctaatttccgggcctcgcttcgttctctctccgcctgggagggacgaaggtattccgggacaaaagcatccgccgataccattttcccttcttttgcatacccggcggctaataccgcgactgcagaggcgcgctgcctgttgcacagagccggggcaaaggaatagggacggcgcattagttccgccagcctcgatcggaatacagggaccccatcccctaaaaagatcacgccgacgtcctccggcagttggttcagcctttctgcaatctcttcaatgggtaccacacattggggctcccgtactttcagagaatagctgacttcaccgaaagcctgtgcctgcgcggcatccggaaggctggcaggagccgccgcctcattcccgctttcctgcacaaaacggtaaatgccggtataaacctggctgcgtctggcatccatcagggggcagatgatctgatccgtcccatacaggttcatcgccagggcatccacggtggggacgcctatcagcggcttattcaaagccaggcccagtccttttgctgttgcggatcctatccggagcccggtgaaggagcccgggccggcagatacggcaatggcatcaatggtgtttaaatccagttctatcattttcttcacttcatccagcatgggaagaagtgtctgggaatgtgttttcttatagttggtggtgtattccgcgataagattatcatcttccgttaccgccacgctggctaccagtcctgaactgtctatggctaatattttcattcctgattcgcttccttccttgtcagggtgattttacgatagtcaaaaccctttttcaagtctttttcaatccggatctccgtataggaggggggaaggatttcttctatgaggttggcccattcaataaggcagaggccatttccgtagaaacagtcttcatagcctatctcatccatttcttccacatcgccgatgcggtaaacatcaaagtgataaaagggcatccttccttcttcataaatctggataatagtgaatgtagggctgctgaccggctcctgaatacccagtcctgccgcaaccccctgggtgaaaaccgtcttgcccacacccaaatcacctatgagggtataaacctgcccgggaacggcctgtctgccgatctgttctccaaaagcaaaggtgtcttccgggctgaagctctcgatctgttctgttttcattatggtatctcctgcgtccgttttgccggacattatctgcaaaggctgataactacattcggatattcacttttttaggaggcatatgcgtggagatcatttccacaactttggagaggctatcctttaaatccctgcggggaaaaatactcgcattgattctggtcgtataaaggataatgctcctgccggtggaaatcgccttcaccatatcctcccacttctggaattccaccatatccccctgggatacttcgacgccttcttctgtcattttataatgaaggggctgcttgaatgccggatttgtgagcgcctgctgctttgctttcaataaaagacttcccggctggtacagcaggattataagtccggcgatcagatagaccacatggcccgtcataccgaacgcaaccagaatcagcgctcctaccgtagttcccaccactccggcaaagctggtataggtatggtggagcatatagtcataaagaactgccgaatcaatttttacatcaaattccacttccataaattaccttcctgtccctgttgattcatacgacccgaaaaagcacctacgtcgtaggtgcttttgtctacttatcattatattatactgaaaatctttcgtaacgcaagagatttcagcctattcatggcgaagcgcttcaatagggctgagttttgccgccttcctggcaggataaattccgaagaaaatacctacgcctgccgagaacagggaagctatcaaaacggtgcttggctgaatccgggctgagaagccaattactcctccgatgagaatcgcacctgtaacacccaggatgatacctataatacctcccagcagggtaataatagcggattcggacaaaaattggagcagtatggaaccggtccgggcacccagagacttgcggataccgatttctctggtacgctccgtgacggaaaccagcatgatattcataacaccaattccgccgaccaaaagggaaattgccgccactattacaacaaagatggatatacttcctaaaacggagttgatttcggaaatctggtcctgcatgttctgaacctgaatcactccctttcctcttacattgtgtcttccttccagcaggttgatactgctctgggccacctgaacggactccgtaggagaatcactgataatcatgaaatccgtaaactccccaaaatacaatccataggacgcgctgagtacgctgagcggcaattcaatattaatcatatcaccatacatgctgaacatagccgcagcactgtcctggcggacacctacaatcctaagatcctgtgttgtcccatacagagttacctctatggtaaggcctacaacatccgtagtaccaaacatcttctttgccgcctgttccggtacaacgcagaccttattaccggaataataatcactggcggtaaaataatgtcctgcaataataggctcactctggtaaaattccatgctttccgtaccgccggacgcatacgcggtaaattcaccttttttgccaattgcactgccgtacatcgtatatacaggggtcacaccctttacacccggcaccttctcttttattgcttcaaagtcatccgagtcaaaataaacctcttcttcactgtgctcattatttacataaataccaatcagccctccggccatggcattcaattcatcattaacctgtcctttaaccccgtcgccgatggatataatcatgattacggaagtaataccgatgataatacccagcatcgtcaggattgaccggcctttattgctcctgatattcatcagggcaatttttatatattcccatgcctgtgccactattcagtcctccttatataggcagcttcgaatagtacctggctattcattttcagatcccagtgtgccactcgctgcctgtgattcagcagtttctgtttctccgcctgcttcttcggaggaaccctctccggccgctgtctgcgatacagcttccgatgccgtttctgtcacagcttccgtttcaccggctgctgctccggtttccatcatggtctggccggccatcccgccgcccataggaactgccataaccttcattccttccataatggtaccagtcacatcatatacaatctgatcgccctctttcaggccttcttttacctcaaccatgctgtcggaggaaattcctgtggtgattcttctcatggtcacaacaccattatccactacgtaacaaaattcgccctgcttatccgcatttacgatttcaaccggtatggttattacattctccgcgtaagcggtatgaataacaagctttgcttccacacccaggaagatgctgtcatcgggattcttgatatggacttccgctccaaccacgggtgttccctgggaattggctgccgccaccttgttaattttggaaacctctccttcatatacattgcccgctattgtaacgtctacctgctggccaatggctattttaggcaaatcgtatttggtaacttctattcctactttgacctgtttattgctttcaatcgtaaagagttcggttccttcggcaacggttgcgccttccagaaggccgccgcccttggtcgcatccttggatgtggatacggtggcaatcttggtgacaatgccggggaattcggctgctacgcctgcccgggctttttccagctcattttcagcctcagttgccgtaagctgggcactctgtgtgtttgccgcctgctgctgtttttcataaggatcggcaattcccgcttccgaggaggtttccttgccttctctcttattgatttcttcgttcatatcatccagtttcttctgttctgcatcgataagacgctgtttttctttcagctcgtcagacatgctcagatcgctgatctgattattcgtttcgcggatgctgttgttcaggttctggatgatctcctgaatactttttctcgtctcagaatcgtgctgctcctccagcttattagactgtgtatccagctcctgattcagttttcccagccaatcctgcagtttttgctttttctgctgctgctcgtcctccagctgatacttcaatccctgtacatactgttcctgctgctctgccagtaccttcagctcaggcaggccgattgttgcttcattatattcagactgatttttattgctcttatactcggaacttttatagctgtatgctgttacggacgcatccagctccgcttttgtcttcttcatttccaaatctgtggtatcaaaggaaaccagctgctgtccctctgccacctcatcacccagggcaatgctcatttcggaaatggtcgcacccacaggcgcataatatgttttgctctgctcactgcttaccgtaccgctggtagataatgtttcttcaatcactccgacggtcgcttccacggtattcacctgcatgggggtgtttttggcaatgacgcttgtcacaacggaatagcccactatgacaatgactaaagcaagggcgataatccagccgaatttcttctttttcttcttgccggtccctccggccataacagcttctctcttctcctgagccttcttttcctttgcttcggctttttctctcttctttttatctttggccgattccaggctgccggtatctttgttctctaactcactcattttgattcctccataatttatcccgtagggtagttacctattatataaagagttctgaaactctgtaaaaaaattattcctcatagttctccgtatcctgattataatccgcttcaatgtagccgtccttgatacggataacccgctctgcctgagcggcgatatcattatcatgagtaattatgattacggttcttccttcctggtgaaggctcttaagaattcccataatttctttggtcgaaccggagtccaggttaccggtaggctcatccgcaagtatcacaggcggcgcctgggcaatggctcttgctatggcgaccctctgctgctgccctccggacatttccgaaggcttgtggttcattcgtttttccagtcctacctttctgagggcatcctgggaaagctccagcctctcttttttgctgattcctctgtaaatcagaggaagttctacattttccagggccgtcagattcggtatcaggttaaaaccctgaaaaataaaaccgatttcccggtttctgatatcggacagatcatcgtcactcatcctggaaacgtcctggtcatgcagaaggtaggttccgctcgtagggacatccaggcatcccagcatattcataagcgtggattttcctgagccggaatgaccgataattgccacaaattcattttcattaatcgatacatttacatgatccagtgcccgcacttcgttttcacccgggttgtaaaccttacacatgtcctttacttcaaccagcgcactcatactttttctccctttgttccccttccggtcattttttctgttttgaccgcggaaactgtttacatttcatctgtattatacagttaatacagtaatacggtttattcattttgtcaaccggatattttatcctgctgacagtatcatccgttccatccccttaaattaaggagtgtcccgaaatattactttgactatcatactatagttacctttgaaaaatctatgtacttcctttaaaattttcttaattttttctaaataacgattgtttttgtataattatcttgaaacaacacatactatccgtgcttccataacaacttataacagcaaaggaggaaatatgagccttttaaataatgatgaaatacccctgggattaggcatggcattagcccagaatatggatgccatgcgtgttttttcctcattgagcgaatcttcccgccaaaatgtgatcgatcgttcaagacaggtgaattcaaaacaggaaatggagcatctcgtatccggactgaccgaagataagaaaagcgagggattcattttttagttccaaaagcttcacaatttcttcaaacttccatcacggaacttccatacttggatgttattgtatatttatacaaagccaataactttttaaaatagatttctttttcataacttgccggcatctgcaaagatgccggccctccctcaaaaaatatggcaggccggacggcctgcctttttgtgtattccttcctctatttattgaaaagcaaactcagcaagataaaacaaaaggaaggtatgtgccggataaaagatgtaaaagaaatatttcatgcccgggcccttctgattattgtatccaagcatcaggggaagggcgagaaccatgagccactgggtagctccgatgcctccgctttcaaacatctctatactgaactggctgatacagaagaggatatacataacgcagaacaaatctttcttctccttcaggaaatacatgagtacccccagggccacgaaagaaaaaccgtattcattcagcgcaagattggggacaatccccgtaagaagatccccggataaattacgtgtaaagggaataatattgggcatgaggaaatacagcagctggacaaaggctatcgcgcccaacaggacggcgccctttttccgatccttctgatatagctccactgtgctgataagcacgcctaccaaaaacatggagagaaaaatattgtgatttccataaccgttctgcgaaacaaacacagcatccacggtataggaaaagaacgtcataaagagactcatcagatacagacgaagcagataccttttccggttccttgtatactgatagccccagaccatgcagaaaagaaacaggggataggagcctctgcccagccatcgaagccaggacggcgttccttcaaaataatagccgatatgatcgataaccataaggacgagtgcgatcatttttaatgtaaaggtattcatgacgagctccttttcgtgtcactccccggtaactgccgcggggcttccgacttgcttcatcatactatagaagcggcctgcaaatccatgcggttcttttaaggtttccttatttttttctaaattatgggattgttatgaatatttccggggaaaacgggtattataggaatatgaaaaatcaatagaggatacattttctatttgcaatagcttcacaaattcttcaaaatttcatcacgattgctatacaattgaatgttatcctttattcatacaaagccagtaagacttttttaaatagattttctttttcataactcaccggcatctgcaaagatgccggccctccctcaaattttatgggcggccgcattcatcggaaagcggccgccctgttttatttatgcttgtgcaaaatctgatgtatttcctttattacagttccccttccagaggcgggccggtaaatttcatcaaatcctttttatggcaccgataataaaccagccccgccacatcagccaaaatccatccgacgggaatagccgcccagatgccggtcacaccgacaaatgccgaaagcagataggcaagcagtacccgcattcccagggaaatcacggtcagcaccacggacatgccggggcgttttacggcgcggtaaaaaccatagagtaagaagaggcagccgattccccagtaaaaaagggcgacaatcctcagatatttcacgccttccgcaaggatttccgtttcctgcggctgtacaaacagcagcataagcggcctggcgaaaagaactacaacagcagatacgaaaatgcagaacaagagggtgagctgcactgattttttaatgccgatccgaatacgctcttcttttccggctccataattctgagccacgaaggtagaaaaggcatttccgaaatcctgaactggcatgtaagcgaaggaatcgattttgacggctgcggcaaaagccgccatgattaccggcccgaagctgttcaccaggccctgtaccatcaggattccgaaattcatgacggactgctgtacgcaggtgagaatggaaaggctgcatatttcccgcaggatatggccgttccaccgcagatccgtgcgggagggcagaaaatttttacagcggataaaggtataaagcgtgatacccaggccggctgcatactgtgcaataaccgtcgcgcctgccgcccccttcactccccagccgaatacgagaacgaacagcagatccaggccgatattcagacatgcggagatactcagaaaaatcagcgggacggaagaatttcccatggcccgcagcagtccggcaaaaaaattgtaaaggaaagcagctcccacgccggcaaatataatccataaataatccctcatcaggggatatacctgttttggcacatgcagaaaggccatgataggatcgataaacagatataccccgacattcaggacggcagcaatcacaaaaatcagtccgaacgcatggaggacagcagctttcagacgctgtgtatctccctgtccctgataaatggaaaacaacgctcccgctcccatggacaggcccagaagaatggaagtaaggaaagtcattaatgtgtaagcggagcctaccgcagcaagggcattgctgccaagaaaccttcctactatgagggtatcggctatgttataaaactgctgcagcagatttcccgccatcataggcagcacaaacagtataattgtctttgttatatttcctttggttaaatcccggtacatggaatgccgctcctgtcatcgtttttgtcacataaattttgccctgtcaagcaatggcatgacagcagaaaaaaaggaaatgagattgtatccgccatgggcaagcatacagcagagaagcgcttttcttatggttaattgatttgaagtattcattttgtctcccaaagtatgaggcgttactttttcagaagcaattccatgggtgtataaacaattcccttatagactgcctgtgcgcctgtatcctgaaagcctaaatggtgataaaaaggaacggcatagggcgatgcgttcagctttatcttatccgctccgcggctgcacatttcttcggcagctttctcaaataagcatctgcctattcccattttatggtattttcctctgacaaacacacaggacaccgtgtttttatccgaaaaagacagcacaccggctaaattatctccgacgaacgctccgtacatcacttctcttttatcagtgaatttatttcggaaaccggctccatggacatattcctgataaaaattatctatcccttcctgcgtataatccggagcaacgaattcgagaaacacctcccagattaaggaaaaggcttcttctgtttgtttatcatccagtattctgatttctatcatctttttccctcatttatcttccctgtattgacgaatagcgggaaccgtcctaaaataaagcttattgattgttccttgtcccatatatatcgaactatgatacagcttatttattataggaaacctttcatgaaaagtcaaagctcccggcaagtacaatggactgaagtccgcgggtctttgacccccgcagccgccagggacagacgaatctttggtccgccgcccgcgggaatcaacgatgattacaggaggaataacgaaatggagaagaaattatccagggacgaagcctgggcactgttaaccgagtacaccaagacccctgccctgcagaagcacgctctggctgtggaagctgttatgagccactttggccggatcaacggtgaagaggaagaaacctggggcgtggtcggtctgctgcatgatttggattatgaaaaatatccggatgagcactgcaaaaaggcggctgaaatcatgaaggaacggggaatcgatgatttttatatccatgcagtctgcagtcacggttatggaatctgttccgatgtaaaaccggaaagcacgatggaaaaggtgctgttcaccattgatgaactgactggccttattaatgcggtttgtctgatgcgtccttccaaaagtgtcctggatttggaagtgaagtctgtaaaaaagaaattcaaggataaatcctttgccgcgggcgtggatcgtaataccatccgtaccgggtgtgaaatgctcggaatggaattggatgatgtgatccgggagacgatcgaagggatgaaggaaaaggccgaagctctgggcctgaaaggggagctgtaggctctgcacaggcgccggaattcctggcgtatttaaaacaggcaactgagacagtctgaacagtttcagctgcctgtttttatgtctgcgtctaaagtttcctgtccgaagcgttctgttcctctgccatacaatcttccttatgagccgctgacagcggtaattcttcttctcctgcctgcgcctgataggcgggtatctgtgtcagatcataaaggttgtccaatgccttattcttacccttccggttcagcctatgataatattccataagcagggctgtttccggttcctcccgtactgcatattcttctatccctaacagataagagggggatacttccaggatctccgccatcttcagcaaggtggcttttttaatattggaaaccctccccttttcgtatttagctatggctgatttctgaagtcccagcatatgggccagctcctcctgggtcatatgcctgtccttacgcagccggcgtattcgatctcctatttccataaaatagctcctctcggaatattatttcccaattatgtgtcttaatattaccattcttttgttaatcaagcaatattttatttattttttctaaataaatatctttttaagacacttatgttgttgacttcctttgcctttcatagtatgctattagtgtcttaaaaagatactaaagagtgtgcaatccgcacttatgatgaaaaggaggacatttttatgtcaaacattgatcttttaaaattacaatctcttttggatgaccaccgtcattatctgcttcagggatataatgtagtcagcaacccctatctcagaaccgaggatatccagatgtccaataccattctggataaagataagcttaatgaaaaattcccgggcaacagcttttataattacgtgagtggaaatgaaacaggttccatttccgaaacctatgcaggaaatactctttatgagatggaaaacagctttgggacgaagaataccattgcctacaattcggtagccctcaatgccagcctttctgcagattaccagacaggaaactccattctggacaataatattttcttaaagcaatatcaggcgcatgtccttggccatatctattccagaggagatgtttccgacctgcgcgaatgcctggatgcacatttccgggaggatctggaaaacatggaacccagaaagttattttttaaatatggtacccacctaatccgtgatttcagtgtgggaggatgtatcatgctggatatgcgttatcacaaccatatgcataaaaccgtacagcaggtttccgcggatgccgccgccgcttattcgggtctcagcctcgattcctccaccagcgcatacaaaaacgccgtttctttttatcagaatgtcagcgtcaggatacgttctgtcggcggaaattctttctcggcgttttctgtcagcgattttaacagtcagagtaaggcctggatggattctctggcggacaaagccgttcctttccggattaacagaaacggcagcctgcctatatgggaactgacgagtaatgccgcacgtgccaaaacgctggaaaaagaattttatctatataatatagatgtcctggacgaagtgaaggcaaatattccttttataaccgacctccgtgtagaaataagggataaagataatatccgttccgtctgccctgaaaactggtatgttgcccagatgaatccggggactctctctgcttatgatattgacctgaacaaaggatcgggaggaaaatatatttacctgctctatcgttttggtacaaatcaaaaggacagaattacagatattaaaattctgatgggacgtaatacaacgctcggcggctataccaggatagatgccgatttgaatacaggatccggaggtgaatatatctatcttgcatataaaaaagaagataataaggaaaaagacgggatttacggcctgggaaccactgaacagtcatcctttacggataattactggaggatggcaaaggatcagaacaataatcttgctgatctgaacaagggagccggagggctttttatttatctgttaacctatcgtgagaaatatcttgatgaaattgaaagggaaaagagagaactgcaggcgctgactgacagtctgaaataaatgtacagatttttaccggaagtaaacattccttcccatatacaacggggactgcctgaaaaggcagtccctgattagcagctcaaactatttcgtattgtggagaatcgggctgattttcttataaatcagcatggttactaaggatacgatgccgcccttgagtatgttcattggtgccactgcgaatacaacaagggtattcacgctgttgatggccgggttgatgacgtggcccatttcgattatggagtccagaggaaggccataaagctccgcaaatttgggaagcagataaaccgcattaaaggccgttccgaatatggtcatcaccaaagttcccacaacacatcctatcaccgcatttttcttgttcttccggaacaggtaaatgatcgaagcgggaagcaggaaggtgcagccaataataaagtttgccagatctcctacgaaggcggtggaggttcctttgaataacagcttcaggattatcttgcagaattctatcatgacggcggctaccgggccgaacgcaaatgctccgataagggccgggagctcgctgaagtccagtttataaaagtcgggggcgaagggaatgggaaaatccattacgtgaaggactgccgctattgcagaaaagacgccgatcatggcaatctttctggtagttagggtgcgttcctttacgccgtttttcttcttttccagtttttccaccacataggctatgattaccatggcggctaccagtcccaggaactccaggacaaaaataaggttttccataaatgttgctgctagattattcataactctctccttttcttttttccggattcccggaaaatttgacagataaggaaaattcttctgacttttcatgaggagtatggctttggatttattacgattgcgggaacggctgccctaaggaaataaaaaacccggagaaatatattctccgggcagatatccaatccataggaaaaagcggcattaccctgtttccggggaaacaataaataaaccaggccttcctctcatgattcttcttctctcatccagactttactgtcggttccggattcttaccggaatcagccgcttatgcgggtcgcggacttgtctgctcacgcagcttcaccgccggtagggaattacacccgaccctgaagaactttacctttattcacctgaaagcagatttccatgttattttaaaaaccgctttctgttacttttttatcatagcaggatttcggcaaaagtcaacagggatttttccccttactgcggcatctcttccagcacaaggaaaccattcctttccagaacctcttcgtctgccgcagtttttttagtcagataattccggtacccgctgcatttctttatagtctgaggggcggatgtaaaattgaacaggaagaagatttttcttccgtccagcaggcgcatgacgcgctccactccgtcgggagccatgacctgttccggcgccgggcaggcaggggcgcatacagtgaggaggaattgctgccatgcttcatcgggcatatcggttcctacgtaacaggcctttccttttccgaattgctgttcggaaatgaccatgcagccttttttatagtcttcctgataaacgccaagcgcttttccggttcctgacagcagctcgctccacatgccgtcgggaacgatccattctcttttctccccttccttcattacgccgttttcacagggcagggtaagtttgagcggtgtatggttttcctcaaaaaccggttccacttcttccacctgtatgccgaatacatccgtcaggcctgcgggaagcggctgggtacagcccgcgttatcttcgtttttcaccccggttaaaaaggttgcgataagaatgcctccctgccgtacatattcccgcagcctgccgcgggtatccgcatccagtataaaggcggctgggagcagaaggactttatagctttcccaggaagcatggcaggaaataacatccgcgttgattccgattcgttccaggctgcggtacagcttctgtccataatccagataggtaaaaaggggatcatttacaggcttgatgcgcagggcccagtggctgtcgtaatccagaaggatcgccgcttccgagggaaactgtgccttggataagggttccagctgttttaacagttccgcggtttctttcatttcataatagcgtcttctggggattccgtccatgtccacaatggcgtaattcagctgctccgccccatagggaaaggtgcggtactggaaatgcagaagcgcctgtgcgccatgggcaaaggcctgaatgaccgcctgcttcagcgccccgggattcggctgcagcctgccggagccgctgagccggtggccgcctcctgacatgaattccagcacccagaagggggcgccctctttgacgcctctggcaaatgcataggggaaggaatccacccgggcattgcgcaggccgggatagtaatcaaaggcatagcagtccagggtttcggtgcttttataatagtctatgctgttggtagcaaggccggtggcattggtggtcaccggataaccggtatacttccgcaggacagccgtctggctattctggaactcgatctggctgtcgctggaaaaccgttcgaaatccaggcgtaccagaggattttcataaaaggcgtttatcagattctgcgcaccgggctctatggaattgacaggaggggtgatctggtcaaagctctgatattcctgggaccaaaataccgcgccgcttctttggttaaaattttctattgtaccgtatttttgctccagccagcggctgaatttttgacggcacaccgggcaggtacatctgccggtcccctcctgggcgggttcgttatcgatctgaaaaccggccacccaggggttctttccgtaatgctccgctattttttgcgtgatccgcacacaggcttcccggtaaaaatcattgttatagcaatagtggcgtcttcctccgaagggccttatcacacctctgttatcctgataaaggatttccgggtgtccggtcaccagccaggccggcgggcaggctgtgggggtacagatgatggtacggatccccgcctgccccaggctttccaccgcttcatccagccagccgaatgcaaaatgcccttcctccggctccatacggctccatgcaaattcccccatgcgcaccgtattgattccggattctttaatcaggacaaggtcctgttccagctcttccttcgttttctgctccggataataggaaactccatataacatcttttcccctattcctttcccgtgaaataaacttcgttttcttctttttgagggactttcccgtccagttccagtacgacgatgcaatccggatcctgcggcgttgtctttcttccctgaggtattgtgatccggagcccttcttctccctgttcaaaaggcacgtcttcttctgttcccaacaggtaacagcgtcggatccgcacgcccggatccgggagcctgcgtccggcaaaggccgctgtgtccaggatatggagatagatccggttttcccggaaggtggttccatatacctcatcttcaggctcgaaagggcctcctcttgtattgtaaatgctttcgccgtaacggctcagccagtctccgatctgcctgatacgctggtggatctcttccgaaaccttgccgtttctgtccggtccgatgttcaaaagcaggttgccgtcccggcatactacattgacaagcattcttatcagccagtcaaaatcggacacgggatcatccgccatccagccccagctgctgccgctgcagatgcacatatttttttcccatggcacgggaatgatttttccctgtatttcatgggagccttcgtcacagtaaaaatcgccttcccagccggagcggggattgatcacggtttccgggctgtgggaacgcaccatggcattgagctttccgggctcccagaaccaggcgctggaggtgtcgcttcctttgtgcgccagccagccgccgtcataccacaggatatcgggtttcccatatcgggtaaccagctcctctacctgatcgtagcattgttttttcatcagcgcggcattttccggcaggccttccggatcaaagtaaccgggaaaccgccagtccatgggggaatagtaatagcctactctgagtcctgccttacggcagctttccgtatattccgccacaaagtcccttcgggatccggttttggcagcggtaaactgctcatagctgcccgcgctgtcccaaagtgcaaagccgtcatggtgtctggtgaccatgaccatatactttgcccccatctccacggccatctgtgcccattcgtccgtggaaaaattctgagggctgaattccatggcaagggcttcgtattcttccttcggtatctgttcattgaagcgcacccattcccctcttcccaaaagggaataaagcccccaatgcacaaacattcctattttggcatcccgccaccactgcatctgctccggcttcagcttcaggccgggaacctttacgccgcccagacttttaaaattgatgctgcttttcagcatggatttcaattccgcccccgtcatttccctgggtattttcttttccattttcttatccgcctttcactcatacatccagtcaagagtatccattccttccccttccagccctgcgttccggggaatgacaggcgcatcctccggtatcacgcccgcaactataaatgcgccggtgccaagataaatctcatgggttcctttttcataagaaaacgcatgaatatggacagccttacagccctgtgccttcagggcgttggcataaaggacagccaggccgcctctgtcatccgcatgggtgttggtttccagctcgggcacctgcagccattccacccctttgtcatcgaaatagcctatcaatattttggaatcctgcgccagggtcagctttatggttatccctgtgacgatggcctcgcccatgccgaaacggattccggtcaggccctgtatttccggcgcgatattctgaatccggctgtcactgtccgtaaacaggcattctccctttttcagggtataggtttccagtccttttccttccagggtaaattccgcctccggcagcctgcttccttccgtttcctcttcttctcccacgggaatccagccgtttttcagcttttccacatttgccctgaaattacggaattctttctcatattcaggaaggcactgtgtccaatgcccataggtttctccattggggaaagggattttccgctggggcgtctgcatgctgttggcatacaggtaggtctctttggtaagagccgtcagcttccggtaccattccatggcctgctcccattgctcctgcgattcttccagatacctgaactctcccaggcatctttcatccatgccgtatttataggccaggatattcatggcggctttgattttccagcagtaaaacagtgtcatggctttcacagccctgcagtcgtccaggattccctgaagccctttgggatccctgacggaacaccgggccgctgccgccgcatttttatccatacgctccaccagatattccagatcctccaccagatcaaagggtgtttctcccacatggggaaggccttctttttccttccgccagtaatcgtccggctgctctcccaccgcggccaccgaatgccacagctctctgttggggcggtattttatcacattggtaagctgggacatggtcatccccagactcatggtctggcggtttccttccgtaatccccactcttccgaggattttaggcgcgcacaggcccatggcttccagggccttcagcaggcttccggcattttcttcgggcatgccgtattggcaggccagccttcttttccagtattccttttcctcttcctccggcctccagggattccatgcatagcggaaccacgcttcataccacagccagtcgcggtgaagctgggtgagccttttttccgatttatcaggggaatagggccagtcccagtaaaacagggggtagaggtgaagcccgttggctccgagccgctcgcttcccgcctggacacatttttggataaaaccgggggccatgaagcggaagggctccaaattagccagaatgtgtacgttcatgatatggccgccgcccagggtgcttaaacttttatgaagctgctgccagtttcctctcggcagataggtggtcaggctctccccattatatttccacatggtatataaatgggtatattcggtggaagcggcttccattgcggctaccgggtcacagtcgtggccgcgcaggatgaccggcggctcctccttcaggccggcctccttcgcgccctgcttcacggcgggaataatcgtgcgggcgaaccagtccgttttattctgcgttccgcgcagcgcctcacccaggcagaccatcaggccgatatggggataggtcttaacaaattccacgatggatttgtaagtatagtccgccacaaggggatggatattgctctggttcagatccagtccgtgggccagggcaaagggcagggaaatatggatgttataaaatttcaggacaacccagattccccttctgtcgcattctttcgtgagccagccgaaaagctccctgtttttttcatattcttcaggggtcacttccagggcttccgggtaatccggtaccttcaccagagaggcaaagggatggccgctccagatgtagaggacattgcagcgttcccgaagcatgctgtccagaaattcctgccacattttcttatcgtagaaccagggaaaacggtccggggtgatcgggtattcataggtatgtctcggcggctccagttttgttttctgaaggcccacacaaggccctctcagcttaaaggccggtgcatcgtaaaagctgagttcaccgggcagttccttttcctcccgcagcagctccgccagcttcaggcatccgtaaagggctcccgaagcgcttccgccgcagaccaccgtcattttcccggggatgcgctggagataaaagccttcgccttccggttcccggctgtggaagcaaagcacctcctcttcctccaaccagttcatcaattcctcctccttacggattcccacataaagcttttctccgggaatcaggcggtattcccatgggtgttcgggcgcttcggcccagccgcagccgtatcccgtttcctccagcgccttttccagcagactgatcccgaactccacccggggttcctctttttccagccgccgtctgtccccgatcagggtgacttctctttttttcatcatatcctttccctcttccaacacactcagcgtgaatccctcttcctgcattcccgcgtaaagcttccttccacatcactccagtgtttctcggcgtgcgacaggattttgtccgcattttccctggacatggggctgaaatacaggaacagggcgctgctgccgtagcgggccaccagcttatccagcctttccagccattcctctgtttcgccgctgtatacctttacccacagggcttttcccgccgccacagccttgtcataaatgggataccattcttcaaaggttccgtccgggccgtaatccccgctggtccactgcagggcgtcgatttcctcaatctccatgatagcgtccagatggcgtatggcgtccgggccgtccagatggtagagggaatgatttaactgcttcgcctgtccccggagggcttcctgcacgaattcccggaactgatcgggggaaatcatggcggagaaatcacactgcagcttggcaattttcccttctccccagatctggaaaaccgtgtagcaggagctttcttttccgttttccacttgttttgccagatcataaaaggcatcataatatgtaaaatataaatcctggacctggttcactctccgaagcagctcctccggttcgtccatcatatcaaaaatggtatcctgggctcccctcatggacaccagcacatccagattttccatgatatccggtattcccacatagaaatccccgtcggacagttcgcatactctccgaaagacctccatatgcttctgaaaccacttgttttccggatcaaaggcgagatccggataatccagccagtcttccacaaattcccggaaccagacggttttcatatcaaacacaatctcgctgcccaggtatccggccatggaaccggggccgaaatccacgctcaggttcgggaagctttccgccagaaagtcgtgggtttcgcaaaagtaacggaaccgttccacaatcctttccggatccatatatttatcctctacatccacggatttcagacgagcggccctttcagcatccatcgcttccggcttttcggctatgatgctcatgagcggccttcccgtgttctcccgtttccagtacttttcccatttctgtttcgtctcttcccaattttctttatatttcattttcctgtcctttctttttccgcaaacaatgacagcttacaataaaaatcctctaaaatcagccggggatccacgctgttgtacacccgtatggggcggtactgcttcgtatgtacataagtcatatccctggtaattaacggtgcaccgatccagtcaaaacaaaatctgtgctcataaagcagaagtcccggtgcgggggaatctcccagcacccaggtttcccctgtcctgaaagggcttttcctggatgtttcttccatctggcaggcaaggagctgttcaaacagatactttccgagcacaccccggggcaatacccggcattccagctccgcaaagcttaccggcatcatttcatatacatttttgggcacctgccacagggggatgggggaggaaaataccacattggcggcgtggatatcatttcccaggttgaattccggtcctccggcaggatatctgccgcctccgatccagatgaccgtaaggcgtcccgcgatggagggttccaagagataggcgctggcgatgtccgtaagggggcccataaaggtgacatacagggggcggtcgtcttcccgcatggcctcccggataatcatcctggctccctccgaatccacgggttctcccggagacggaagaggccggtccgctccccggaaaaggagattctcttccgggatatccatcagggaaaggatcttctgaagctctccgaagctttgttccatgctgtccgccgccctgtccatcccgaaatgggcggctatgagccccacattttcaaaacggggggacagaagggtatgtaccacagcgaagggatcatccgcctcatttttcgcatccgtatccgtgatgacacggatcactttttcccggggcacctgaaattcataattctgataccgcatttttaacgcctcccctcaggagcgggtataagctgctccagttcttctttcatggcggaaagctcttcatccgatacctccgcaaacggggatctcgcgatctcctccacaatggtaccctctccctggaacgggatgccggacacggctttcgggaaatgcctcacgatgatttctcttgtttccggtatggacatcagctcattcaggttgctgtccataccgaaacggcggcgatagggcctgcacggacggtaggtgaaaagatagctgcccgcctgcacctgtgtctgtacgtcctctccctgtatttggaacgccggtttccattcttccccggcgtcaccttccttctcctgccggatcagggcgccggcccctcctggcagaaccagctttgccgaggccccgaagggaaccgtaaaccgaagccggagcgagccgtcttcttccagttcccacccggaacggtaggttccggccggtgtcaggagttctcctttgacatagcggagccggtaatcgggtctgggggacaggaccgccttccggaagcccggcgcatcctcctgcgggttgattcccgcggcatagcggtacaggaaggaggcgatggagccataggcataatggttcagggaattcattcctgttccgcttacggaaccgtcaggcagcaccgaattccagcgttcccagatagtggtcgcacccattttcacttcatacagccaacccggatattcttcattcagcagcagcccgtatgctttttccgtgaatccgtgatccgacagcgcggggcacagatagggcgtacccacaaaaccggtgttgagccggaaggcattttctttcattttatcgaagaaagccttttttacctgttcccggaaatcctccggcaccaggccgaaagcggttactaccgcgtaggcggtctgggtgtccaccgcaagccttccggaaggggtataatattcccggtaaaaagcctgcctgatttcatccgccagagtatcgtaacgctcctgctcctccttctttgcaaggactccggccgcctttgcggtgagccgcgcagaataataatagtaagccgtcgccaggaagtaaggatccgtgcttccgtaaactccgccgtccaccttcccgtccagtgccagccagtcgccgaaatgtctgccggtccgccataaacggccgcctccgcttctttcttcttctccccggatatattccacccaggccttcatgcttgggtactgggccttcagcacataaggatccccgaagtgtacataaacaacccagggaatgatggcagcggcatctccccacgcacaggcaccgttcagctcgtagcgtgacatggggaccacatagggcacgctgcccccgcatttttcctgttccagcgccaaatccttcaagaacttcatgtaaaaagcgtaggtgtcacagttgaagctggctgtatccgcaaaaatctgggcatctcccgtccatcccatccgttcatccctctgcgggcagtcggtgggcacatccagaaaattcccccgctgtccccactttatgttggatataagctggttgaccatgggcgacgaggtctgcagacttccggtttcttccatttcggaggaaatcacacagccggtaaaatcttcgggactgactgttcccaggaagccttctattttcacataccggaatccgtaaaaggtaaaatgggaacgggccgtaccgggctttccgtccgatatataggtgtattcacatttcgccgtgcgcatgttgtccctgtaaaaattcccgttctgaaggatttccccgaactgcagccggactgcgatccccgcaggctgattgacggtaaattccatccagcccaccatattctgtcccatatccagtacggtttcccccgcgggcgtatgcagcagggccgccggtctgagacgctgcactatccggatgggaggactgagcctgggggtgaggcggcttgtggaaaggcccgcctgtttcaccggataatcggtttctccctgccctctttcgtcataaatttctccgtcgtagatgctgtcaaaaaggacttttcctttcctgaccgcccagcttttgtccgtacccatgacgcgttcctctccgtcttcaaagaaaagatggagttctccgataaacgcatactcctccccatggcggggcagctttgctttcagcccataaggccctttataccagccttcccccagcatggcttccagcgtatgggttccttccgtcatcgtgagctcataggtctgatactgcagccagctgtcataggcatgaaggccggggagaagaacctcttctcctaatttttccccatccaggtaaagttcgtaaacgcccagcccgagggcataaaggcgcgcggttttcagcggtttttccacccggattttcttacggaataccggatgctcctgctgggagaaggtctgtgtgataaacacgccttcccaggcctccccatctccctttgccgtctcaaaccaggcaggctcgctttcacagacatccccggcatcgtcccagaccgtcactttccaataataccgcgtccggggctccggacggaaaggcagctcataacagatgctgtcaatatcttcccttttccccgaatcaaaaataagctccgcaaaagtttcctcttttgccgcaactaccctcacggctgtctgccggcttcccctgctttcctccaccacataggaaatccttgcgctgtccatgtaaaaccccaacggattctccatccggttagtccgcattccagtaattttcattcccgtttctcccctccgtgcttccaggcacttccgcagtcttctcctgccgcgcatcccgataattgcctttttccttaaaaagacgttttaccacatcataggaaagctttttcctgcgcagctcatccacaacgcctttgttattcatggtcctgggcctcggcccaaaccattcctcactgacacgggtatcgcagaactgccataaatacagcccattgcagctctccagcccgaaaactccccggatctgcttttccagcgcctccgcctgataatcctccgaccatttcgtccggcggttatcccgccatccgtagatagcgcccgcgccgatctccgatatcagaaagggaacctccccgccgcactgctcccggatccagtcataaagatccgcggcgaattcctccgtccttctgtcgtgataccattccggatagatattatatgcttttacctccggcgtctgtattgtcagatccagcttaaaccggcagctggcggttgtcctgggacggcttgcatccagctttctgatcagcgcaaactgtttttcataacaggatgccccatatggggtatggttggcgcattcatttaatatcccccaaatataaatactgggatggttataatgggccgttatcatttcccggatacaatcctcgcactgccgttcaaaaaagggattcctcatctgctcctccgacaggcctctggcatggttttcctcccagaccagaattcccttttcgtcacacagatccaggaaccgttcatcgttggggtaatggctggtgcggacggaattggctcccagatccgacagcaggttcaaatcataatccatggcggtgtaagggatggcgcatccgaacagcccgtgatcctcatggcggcagaagcctttgatataaagcggtcttccattcagcaggatctggttttcctttacttccacggttcgaaaacccgtccgttccatacagtcgtccacagcctttccatcccggtacaaaaccgtccgaaccgttgtaaggcagggattctcagggctccaggcttctgcccggaggaaatctgtttgcaggcccaccacccggcattctccggaaggaaccgtcagatccggtatggaaaaacaagcgtcacaaaggctgacttccagtttcccgcagaaggggctggctgccgtattccgcagggaagcctctatccgggccttccagccctccgcctcccatatgggggtaatatgcacccattccataaagcagtccgacaccgattccagcagtaccggcctggtgatccctaaatagctctcataatcattgggaatatgaagggccgacttttccgaataactgttgtccgccgtcacctccagcctgtggatgcttcccggcgcaaggccgtttatcaccagttcaaagggagtgtaagcattataatggctgcctgcgggcgtgccgtccaggtaaatttccgccgtatggctgatccccttgaagcacaggcggatatttcccgactctccgggcacagtaaaatccgtgcggaaagcggcttttccccggtagttttcatatccgggaaggcattccacacaggagggcagggctacctttcttttttctcctgccttatccccctccagggcttcgaattcccagagatgctccgtcagctcctgctgtcttcttattgttgttgtctgaaatgtcctgatcatggttctccctctctttacgtcccgacaggcataaaaaattccccggtgactgtttccgttactcccgcctttaaagaaagcggcctgtgtattccccggtattccaggctgataagcatctccctcgcagctgtaaagcgggcctcctccaggcgtccttcctgccagcggatgcccacacggacattccctctagccaggagtccgtccacgctgccgcagtcccattcctccggaaggcagggaagcaggcgcagctccccgctgtggctctggagcagcatttcggcgatgcccatgctcaggccggtattgccgtccagctcatagacctccataaaagaaccggctcctcttgtgggaggatgcatgaccaggagattgggatgggtcaattccttctgcatgctccgaagatggtgtgaaactgcttcttttttacgcagcctggcgctgtagagcaacagcagggaacgggcccagccggtgtcctcccagttatcctccggacacagacggctttccatgcttttccaggcggcttccgccagctcaggggtcccttctggcgtgatctgtgcgtaggggaatacgccgagcaaatggctggtatgccggtgctgggaatctgccgcaggatgggagtgcgcccattccgccagcgtcccgtccggcagaatccggtaagggagcagacggggaaggattttttccgcctgcatgacaagcgccctgtccttttccgccaaatccggcaggaaagaggccagctccaggaattcctccagcagttcccttatcatcaggatttcataagtacagccgttggagaaaaagcgtttctccccctcttttatatacgcattttccggagatatggacggcccggaaagataacagccgtcttctccttcaaagacataaccggtgaaaaattccactgcctcccggataacagggtaggcatgttctctcgcaaaggcctcgtccctggtatagcggtaatgttccatataatcggaggcctgccagatccctcccgtcgggcagggggaaatggtgcgtgaccagtaaggcgcggaaaatccccaggcattggaaacaagatcggcgctccagcctttcctgccatagctttcccgggcgctgatccgccccgaaggaatcagcagtttttccatccaggcaaataacggcctgcggcattcgggcagatttcccggcccgctcagccaatagttcatctgggtattgatatccagatgcatatcacaggtccatccgatgcggcaggccacattgtcattccagacgccctgaagatgggccggcagcggggaatcctctctggaagaacactgcagcagatatctgccgaactggaaagccagggcaaaaaggagcggatcctcctttccctgccgtgaagcaagcactctttcatccgtagggacggcagccgcgtcctcctgttcttctttcgtgccaaggcacagggaaacccgttccattctgctttttacgtcttccatatgacggctgcgtatccggtcatattctttcggcagactttgcttcgcacagcccgcctttttatccttacaggccgttaagcccgctttctcttcatagtccgtttccatccacagcccaatcagaagcctgctgcatccggtaaaggcaatggttccgcccgagcaggaaattttgccgtcctcgcaccaggctttcaccatcccggaaagatccactccgcagctgccgtcgctgtgcagtttttcccttgcctgtacctgaaaacggtattcctcctcttctgtacgggccgaaaaaggattctctccgccttccacccatatcctgccggacaggctttccggttttccggtttttatttcataacagaagacctgatccggccaggatacaaaagcattcctgacaacggtgcttccttcctgccggtattccatggagaacaggcctgtttggagatccagccttctcacatatccatccggcttttccccgctgttttccaacataattttcagcctgcccaccgggaggttcgttccgtaattttctctgatgcctatgaaatcagaggctctttccatagccgcctcttcttttccttcctgaagaagagagcgcatttcctgaaaagccagggctgctcccttttggttattctccgaagaagaactgccggagaaaaaagtgatttccgacaaatccaccgtttcctcaaagacacctccgtaaacagcagctcccattctgccgtttcccaaaagatatgcctcctgccatctttccgcttcctttgcggaccaaataatatcctgcatgcgcttcactgctcctcctgcttgactttgcccctcattctctttattattattttaaatggtccggtttttcccggactgccgtaaagatacagactatcggaaggggggcttattatgtatcaggctgtcattgtggacgacgaacctgtcattgtgtcaggaatccgggacgccctggattgggaagggtttggttttgaaatagcactggccaccaccagcccggcaacggtgctttcttttctgtccgttcatccggtgcatcttctcattaccgacatctccatgccggaaatggacggcattgcgctgatacgcgaagccaaagcccttgttcccctgctttccgtcatcgtcctcagcgcctatgataatttcgattatgtgaaaggcgcgctccgttatggtgcggaaaattatctgctgaagcctctttcctccgatgagctgagcgattccatccgcaatgtggtctcccatgtcaaggaacgggaagtcctgaatatgaattacggcggaactatgctcaccttccgcagcaccttcgtggagcagtggctcaaaaatctcctgacgccggaaacccttctggaacgggccgggcttctgggaatcaatctggaaatggacaactatactgcggtgattttcagcgccgataaccgtgacgccgcatccatgtcccgtttctttgattttctgttatccctgctgcccggaaggtttcttgcccatttttacttcgaaatgccttaccgtctggtctgcattttttccgggctggattcttccacggaaatacgttcctttgtcctgcatctgctggctttgtccgaaagcatggggcttcccatctccgccagcatggggcagacggttcctttttaccagtccgtctgtgaaagctaccgccaggcctgctccactcttttctgcggctgctgccgggtttcctatgtctcacaggatgattttctcggacagggaaccgccgaaaaactggttaaactgttggaggccggggatatggatgctttccgtgccttttatccgggtctttatgaacagcatcagcccttctgctgctccgttacccttacctcctgcctgctgtcagacttatccgcagatctggacgagcttccggaaaaatatcccgcccttgcccgggcactgctttctttccccggcagggaggaaaatgaggacagccactgcgtctttattgaacgtctcatacaggaatgcgcggcaatcaaaactgccgccagccaatccatgtatccctgtgtgaatgcggtcatcaaagccattgaagaatttaaggataaggacatctccttaaaaaccctggccgcccgcctgaatgtgtccccttcctatctgggcaccgttttcaaacagcagacaggctattatttcaacgactatctcaccgaagcgcgcatccgttatgccgcaaagctgatcgaaactactgatatgaaaatgaaggatatcgtggacgaggtgggcttttccagccagacctattttaaccgcatgttcaaacgctttttcaatgtatcccctgtggcctaccggcgggacaaaaagctgaattcctgattttgaaagaaggggctgtttacacagcccctctttggttttattcgtaatccttaaccttctccagtgcattattccattctgtggtatagtattcggttatctgatccaggccgagtcctttggcatcgtttaccatggtctgccataagctttcaaattccgcttcgtccttggcatataccatctgccaggaatatttcttcacaacttcaccgatctgtgtttctatgatctgctggtcatcggaagggatctgaaccatgtttacagcctgggtggattttcccaccatatcattggcgtacaggtattccgcaagggtggtggttcccagccattcgttcacttccaccttcattttggtcttggtagcatctctttctatggtggacggccagtaacggtagctcagggtaaatccgtcgtccagctctgtggcggcctgcggccctaaggtattaaaggcatacacaccatcctggaaagcgcctccgcccacatcttccggcatgagcatctctgtcttctggtcaacgatatcccagtttgtgattacaggttcgccgttttcccctttttcccatgccacgccttccggcccgttggtaagatattggcatacatccaggtcatataaccagttaaggaattccagagcggcgtcgggattcttgcagctcttgctgattccgaaataccagttacgtccgatggtctggtccggcgcttcatacagcttcatatctttagccactacggatgcatagccgtccggatcctcttcattgttcacatgtcctgcgttgggatcattgtaggtgcctgtaagccaggaaaaccaggaaaacataactcttccggagcttaatttcgccaccatttcatcataggtctgtgtcatggcatccggatccagaagccctctctggttcgcatcaaaatagaatttaagggctcttttataaaagctgtcatccgccaggagagactttgtctcgttggtgatgatattggtttccatcaatgtggatacatattccgtatcaattccgtacatgaaggaaagggtggagatttccagcgcggtatatttatcccagtctgagaacagggagaagccgtataccttttctccgtccggcgttgtgggcttttcctttaccatctgctccactacatccagataatcctccagggtattaatctccggtttgcccagcgtcttatagacagaccactgaagcagaggcacccagttataagcgttataagcggtgggcccgattgccgtgggcatgatataaagcttgcctgaaccgccgctggtataatcctgggaatacttgaccgcattctggtacacttcttccccgaaaatattaggcagctgatcctggtattcgtccagaggcaggagcattcccgcatccatagccagctgtgcctgatccagccctttgaagcctatgatatccggaagttctccggctaccagatactggctcagcttggattccacttcgttgccggtagggtcgaaattaatcttcatattcaggtcgtcatgcagtttctgtgctccccagccctgccatatgccggactctccggttacagactgctggataaatgcgctgagcgtcacttcctccctgctctgttccctgtccgctgtctgtgcttcgctctgctgcgctgcctgactgcccgacgtatccgctgaattaccgccgcagccggccagtgtgccgacaacaagtgctgctgtcattgccagtgccaatcctctttttctcatttctcttctcctcttggtttataatgttagtttagcagtaattgttacctaccctttgacggctccgatcataatgcctttaacgaagtatttctggaagaacggatataccaacagtatgggcagaatcgttactatggaaatcgtgtatttaatggtgagcggcgacagctgggtcgccaggtcggcgttcatggccgacggatcctccctggctatctctgccagcgtatttgcctcattcagataacggtacagcacatactgcagggtctgcagcgatttatccttagtatacaataccgtatccatccagttattccactgtcccaccgcggaaaatacggaaacggtggcaaggatgggcttggacagaggaagaataagccggaagtaacgtaccaggtagccggccccgtctatttccgccgattcctccagggatgccggcagcgattctatgtaggttttgcacagaatcaggttgaacggtgtcacgataccgggaatgatatatacccagaaggtattataaataccgatggtcctgtaggtcaggaacagaggaatcagtcccgcgctgaaatacatggtcactaccacaaatcggtaaaagaattttcttccccagtattcattcctggtgaaagcataggccgggaaggatgccgcaaatacggtgaaaatggttcccagcaccgtcctcgcaatggaaacgaacagggccggaggcagctccttaagggtgagcactctgacataattctggaaatggatcccctggggaaacagagaaatcttccccgtcatgaccaggttgttgttgctgatagtgttgatgaaaatatagtaaaatgggaaaatacagacaatggtaaacagaccgaatataatcgttataaaaatatccacggcccagtcccccgcgctctttttccccactcttaccttttcttcggcttctttctttgccatttttacttctcctctcctttttccggactgtccggacaaacgatatgattccctcagcaaaccaccttagaaaagggcggtgcctctgatttttttcgacagcttgtttgccccgaataccagtatcaggctgatgatggatttccacatgccgattgcggtggcataggagatattcccctgtacaagaccgttcctgtatacatacaaatcaagcacttctataaaatcctgattcatggcattggaaaataccagatactgatcaattccgttattgatgatatttcctatctgcaggataaacatgacaaagaaggtgggaatcaggtggggaatggtaatatgtctgattttggcaaaccggcctgccccgtcaatgtttgccgcttcatagatttccgaatcaatggaggtgatggcgcttatgtacacgatggctccccagcccagccccttccagagatggtaacccaacatcttgagccacatatggctgctgcttgccaggtaattaacaggcgtttccagaattcccatgcccaccagcaggttattcagaagtccttctgtggaaaggagggaataaaacgcggaataaacaaggacccagctgataaaattcggtatggttgtcagcgtctgcaccgccttccgataccgtttggaggggatttccatgaggaaaatcgcaaaaaacataggcagtatcatggcaatcagatacaggaaattgatgcccagcgtattggccataaccctgccgaactgcccgcgcagaacggagttggcaaaaggcatcgtaaaccacttcagaccggtaaaggtacaatcccagatagacaatcccggcttgtaatcaaaaaaagcatatatccaccccagcaggggaaggtatgaaaaaataaagattcctatcaatataggcgtggtcagcagaaacagacgaaaaccggcttttcttctcggattgactcccgtttttgctttttgttcgtttttactcatttcctttggataccccctaatcctcttaaactattatcgctcttcctgtctctattatggggtgtaagtgtttacattgtatatagtacttattttaagtttttgaaataatttcaactatcttgtgatgcaacggttcggcctttggctgtgccccgcgcctggccttcccgctgtgggtgctcttcccggtgggtctgtgtaccctgcaaaggccttctaaaaacgccggtccttggattgcgtcttgtgcaatcttagtaccgctgcgtttttagcagagcgaaagcgtgcctgcgcagggtacacagacccaccgggaagagcacccacagcgggaaggccaggcgcggggcacagccaaaggccgaactgttaccttgtggttgacagattaatttcattgatggaagtcttaaagattatatgataaaatagatgacagctaaagtctgtgattgcagagttcaatttgaaagctgatttctaataagcgaggtgcgggatggctactttttatttagtaagacacgggcaaactgattactcagaacggaataagaaaatatatcagggatttggtgtaaatttatctccattaagtaccgatggagtgaaagaaattataaatacatcgaaagataaacggctttgtgaagcctgcgttattttatcttcaccgtatacaagggctgtacaaacagctgctatcctttcaaaggagcttcagattgatataattattgaaacagatttgcatgaatggatggcaaataaaaattatgtctatgaagacgacgcaaaagcagaaaataattatcgtgagtttgttaagtttaagggcacatatcctgctgattgtaatatggattgggaggacgtgctctcaatgagaaatagaattttaccggttcttgaaaaatataaacaataccccaaaataatagttgcctgtcatggaatgttgattcaatctctttgcaatggataccatcccaaaaacggcgaaattgtagagtttgaattataacttcgtattacgttcaccacccccttacaaagaaggcttattacgagatataagtaaatataaagctgaaaacatctattattaatgaggcggatatgaggaaactgaggaaattattattgcccaagggcttctatacaagtatgttcctgttaagcgttattattttaggcgtattctccctgttcagcgccctgattgccgggagcatggcgcagcgctatgaaaaagcccagtatttcaagaattatgattatgcgcttcgaagcatttcggatacgtttgcacaaaaaatagttgattttcccaacggaatcgcccttaaaatcacaggcggcaccaccagatgcaatgaatctctctgccgccttctggaggcccgtgattatgaagagataacgccggccataagaagcaatgtcatatccgtactgcattccattgtacaaaatgataattatctgacgggctttcttctgtactcttcggaagaaggacatctttattattacagccgtctctcctcccttacctatctgccccggaccccgcacaatttttccacgctggagccttttaccaggcagctgatatctgacgagtggctctcggatgtttttacggagaacggtatccagaagccgtcttcccatatttacgggctgaccgggactctgttccgcagcgcaaaggagcctatcggttccctgatagctctgtattccacctcggagctcaccggcgtgctgaaccgttatccgctggatgaggacagtacctttctcatcaccggccctgacaatcagattcttttcagttcggatcagaactactcagcagccctgctgccgttggattccaaaccggatatccctgtttcggattccggctcctttcccgccctgctgccgctgggaggaaagaactattatgtgtcatccctgcccaacaggaatcacgccttccgcgctttctatcagattcctggaaacagcctgcccgccaattacacgctgtccctgattttcagcctctccgtctgcctgtttctggtgtcgctgtgcatgtatctgatcacctgctttatcgggaataaaaaggtaaacagcatccgggaagggatgaaacacatcggagatacgaatttatcctatcggataccgcctactaaagggcaggatgagttttcccaaatcatatccggctttaacctcatgtgcgatgccctgcaggaaaacgtggaaaagtcttatatctatgagctgcagcagaaaaaatcggatttatatgccctgcagaccagcattaaccctcattttttatataacacgctggaaatcatccgtgttcagctgacccaggggaaaaatgcggacgcctcgcagatgatacttctgctctccaaaatttaccgctcccagaccaaccgcagcatgtatgtttccatcggcgcagaactggaggcgtgtgaaaatttcatggttctctatcagtaccggttccggaattttgaatatgaatttgatgtgccctccgggcttcttccctatgggctgcctaaaaacacgcttcagcctctgatagaaaattatttcgtccacgggatcgatccggcgcgggaggacaatcttttcaccataatcggaagttcttttgtgaaaaacgaagtggaatatatctgccttgaggtctcggacaacgggctttgcatatcccaggaaaagctggaagccctcagggaaaaactgtcaggaaacatctatgcagacaaaaaagaggaaggcttcgccctcaccaatatcaataacaggctgaaaattgtgttcgggaatgactgctccatgaacccttccatccccatggacggcgcaggcttttccatgagccttattttccccaagcgtctgcccgtacggctggaagagggaatgagccggacggttttggaaaaccgcagcggccccggtgcaagatagtgtaaaaacaccataacataaggcaagacaatccgcttccgtcctgctatcctttaactgtcggcatgtaatttccggttcttcccctgccgtcggaggccctccccttccgccccgccctgctttgcccgttcgttccttgtccgccctgtgccgctccggcctgcaaggttccttacaggggacacttccgttcggataagcacgcaacggtactaaggctgccaaggacgcagcctaaggaccggcgagcttataacgccccttacaggaatccttgcaggccggagcggcacagggcggacaaggaacgaacgggcaaagcagggcggggcggaaggggagggcctccggcagcaggggaagaaccggaaattgccggggaaggcaaagcagagaaaaggagcggtaagcgatgaaaaaatttacgatgggagttctcggtctgggggaaggcaggagtatcatatccgccgtacaaaacagcgagctctgggaactggggaacatctgtgatttgaatgaagaattgtgtaaagaacgctgtcaggaattcggtctggacggctataccacggaataccaaaacatgctggatgacgaatccatcgatgtcatcgggatatatacgccggatcagcttcatgcggcacatatcaaaatggctttggaggcgggaaagcatatcatctgcacaaagcctcttatggttgatctggatgaggcaggcgctctcctggaggcacagaagcgtaccggaaaaacggttttcgtagggcaaagctcccggtattttgagccggccagaaggcagaggcaggattttgaagaaggcaggctcggcgagctgatcactgtggaaactcattatatcagtgattccagatggtttctggacagggaatggagccgccggaagggcttttcctggatgtacaattttatgatacatgcggtggatttagccgtgtggtatctgccggaggtggaggaagtatacggccttggcacagcgagtgaaaacaccagggaacgagggatccaggcgcccgataccatgaaattccttctgaaaaacaaagacggcagattcgccggcgtaaacggcgtatatgccgcgcccactctgggcagcgccgtggaacagtccatcagctgtacactccggggaaccaaaggcatcagccgggccgggtatccgaagctgcaatattatacgaatttccagccggtacaaaagacagcccagctacacgaatataatgaactgcatgattattttttccggttcgaagcggaaacccatcatgccggggaataccagaactatatcgaacaattcgcccgggatatgaatgagggaataactcccaaaccggatctgaaggaagggatccgtaccctggccgttatggaagccatggaacaatccctccggcttggcattccggtaaaagtatcccaggttcttgcagacaggaatctctgtccggactgatatccgtaccttcacagttagccggactgctagctgttccgtaccttcacggtcacccgggctgctgcaaacataccttacttcctgaattcgccgggcgtcatatgcatatattttttaaacatccggttaaaaagagaaacggatccgaagccggaagccagggaaatctccgcaatggacaaatcctcttttttcagaagacagcaggcgtactggatccgcacctgctccacatattcaaaaaccgtctgattcgtcatttctttaaagtatctgcacaggtaggtcttgctgacagccaggctgtcagcgatctcctgcagggtgatctcttcccggaaatgctcctcaatgtaggaaaagacctgctccgtccgcttttccggatataaagccgcattcccttcctccgctatatgttttctgcccgcatagtaacggtacaggtaggacagcagcaatacgcccgccgcttccagcacattcctccatccggtttccttttgttccgcttcttcttttatggatgaaaaagtctgatccagcttatcatagccttcttcctttttacggatttgattggagaaatcctccgtcctttggaaaaagggtttcagataatcctggttataccagtccttccacacttccgaggaaaacaggatcacggtcatgcggacaggttccttatgcacggccagatgcctttcccggttattaatgacaaaaatatcccccgggcagatttcataaacttttccgccgatgatatagtttcccgtcccgctttctatccggttcagttcaaggcagtcatggcagtgcagagtctcctgcttctttgcgacatcgaaaacctgaatcctgctgccctcctcaaactgaaattcttcatgcctgtagtccatgcgttccatccttcatttcctgtgacggtttattcctgcacttcccggattatcacatccacatccgccgcatctatggcctccgactcctgtcccctgatatctatccctttgaggcacagcctttccacattccggaaaaacaagcctttgcggcacattttttccacgccgcacatcatggccggcagacccggacgggcatccttggcatatcggatccgcacgtcttccataatgacagatttgatctttttctccggaagtccatagaagaaagccgcggcgatatggcagtccgtgcagtaaatatgacggaataccagctctcccatattgggcgtccgctcatccgccggaagagcctctttcgtctgcacatagtccgaacggccgtccggctcacaaaagtaaaagcagttcagcacgaaaggggtatccacctgctccatgtgtatattttcaaaaagaacggcatccaccacacatgactttcctctgcctctccttgttttgatccgaagccccctgtccgtattcctgaaacagcagtccctgaccgtcacatgatggacgccggagctgatttcactgccgatggtcacgccgccatggccattttccataaaacactgacggatctgaatatggctgcccggtacgggattttcctgtgcccgcctgcctttccctgattttatggcgatacagtcatcgccaagggaaaaatgacaacccgcgatttccacatgctcacaggattcggggtttatcccatccgtattaggggaatcctccggattgataatctccacatcataaatacccagatcgctgcagaagcagggatggatacaccagctgggacacatggaaaaacgaagcccctgcaccctgatatgtttacaatgagtcagaaacagcatccgcggcctgtggggagagctctgcctgttctcctcactccaccagtcctccatggaagcgcctcccagaatttctcccttaccgtataaattgacattctctgcgccgcatccggtaaaaagggcggcatacatatccgccgcttctccttcccaactgcctaaagcaagactattctccccttttccggaaagaagcccgggaaggatcggaagacgtccgggccgtccgtcatatataaggacggccccctcctccagttccagattgctgttgcttttcagaaacaggctggtcacacggtattttcccggcggaatcaccaccctgccctccggcggacacgccatgatcgccgcctggataaagacggtatcatcccgttccccttcacccgaagccccgaaatcacggacatttaagacggctgtctccagttttgtgtgaaaagagatttctccccggatacttccatcctctcctgcaagctgcagcaggtagtccctgtcgggagacaggttaaacagagaggtgacaaccttctgcgtcgttccccgctcttccccgttaaggaagattgtatatgcctcctccagcctgtaaatactgccgcatttgatttccaccacagcgcttcccgcggtcagcatcaagattgcaagctccattttccttctccctgttcctgcctgtttttaagaatatattaccacattttccgactgctctgttccgttgacaaaaagtttctttgttttctcttcccatacaagctccgtaagctcatattttccctgctcataagcataaccatcgccgctgtccctatataacgtaaagctgcagtccgctcctgcatagatacggtattccacttccgcttccgctgcccggaccgtattctgcgccgcctctgccatgggaaggatgctccccgcttttacgaacagaggaatccgggaaagaggcgcgtccgcttccacgtactgtccgcctgcataacgctccccggtataaaaatcataccagtcacagcccccgggaaggtacacggttctcttttcaggaataccgctgagcacctcagagcctgttccgtaatacataggttccgtcacagggcagaccaggatactttccccgaacatatactgatccccaatatccagagcattctcatcctgcatgaaatcaaaggccagcatacgcagaaaggtcttatcctccttccacacacggtaagcccaggaatagatgtaagggagcaggcgatagcgcagggaaaccgctccgcacagcgcttcataaaaaccgtccttcccgttatcaaacagccatggctcccttctcacatccgtgccatggctccggaatactggaagaaacgccccatactggaaccatctcacgaaaagctcacgatagcccagatccgaaagtccatcctcataattcccattccagaaccagggctcccctttcttcacaaaaaaggctccgatatccaacgtccagtaaggcaggccgctggcgcagaaattcagccctgccgctatctgcttttgcagcgtttcccaggatgcgtaaatatcccccgaccagagaatcaccccataacgctgcccgcccacataggaattacgggtcaggttcaccactcttttttcttccgaagcctctctctgcccttcataaatcgttctggcatgaaacagcccataagaattcatacgctccgcgggaatatatttcccggcatcccgtacaaagtccgcatacatttcctccggccccggcttcaccttcctggcccattccggcgtaaaaggctcgctggaatcacaccaccaggcatccaccccatgccggaaaagcccttcctgcacctgtttccagtaaagctttctggctttctcatcaaaggcgtcatagatttcactggcgggaagcagaagctttttctccaggaattcctcataatcagccgtacttttactcatattcggccagatggacagcatgaaatgcacatcctcctgatgcagggcatccgtcatcgcaccaggatccggaaaacgggaaggatcaaaactcttctgcccccacatgccgtcctcccaggaacaccagtccagaacaagcgcatccaatccaaagcccctgtccctgaattcccgggccacatccaggatctcctcctgtgtttcatacctctcctgcgactgaatgaaaccataagcccatctcggcagcatggccgcttttccggtaagcagccgatacccgctgatgatttcatccatggatcccccggcaataaagtaataatccatttcctcgtccgcttccgtatagagataggaaccatactgcgtatcctggaatatggcggtactgcctgtggaaagaaggattccatagccattggaggacaccaggaagggaatggctatcttcagattcgcctgatggagatactgcacgcttccccgcagattcagcagaccttcctccgcctgcccaagcccataaagcctttccgactcctgccacttcaggtgaaggcgggtgtgatacagcttcttgtcaaataccatacttgcttccttgataacacgctttacgccgtcagccgtctccacctcttctattttggtattctcatcaattaccgttttataagaatcaaattcctccagctccctgctgtcctcttcccgctccgccagaagcagccgcccgttcctttccagataacggatactgcccgtcctcttatccacctccagggcaagcttctccgtatacagaaccaccctgctttcctgctcctcacacgtccagccgtcccattccttttcttccagaatgccgatcccgacgtttcctgtaaattcacccttctgcgtataactgatacgcacaatagaatcgttcctgggcttcagccgcagaagccccttctgcgtctccaaaaaaagactgccgcccctgcggtaagtcttttccaccaaatcctgttttctctttacaacctccagcatataaaatccctctccctttcatcactttgtaccgccaaacgcggagcattatcggaacagcaataacaatccacggacctgaactgctatgaatcccattttttattcatattaccatttttcctccctcttttcttgcactttcccctcaaaaaatagtataattctgacatcagcaaaaactgcccgctcacatgaaatacgggatgcagaaacattcccggatttcctacattccgaaaccaaacaggaggccagccgcatgaacttattcttacaataccaggaaaccggcaccagacccatgagagatatccccttctacatttataatctccaggttaccgaacccggcccccacgtccccatacactggcatgaagaactggaaatcattctcccctccgtccccggctgcctggaaatcgacggcaaccgcttcccttttcaggaaggcgatatcatgttcgtaaacccgtacgaactccatgccacccgcatccaccggcccggacaggtctgccacatgctcctgcgctccgactgttttcagttcctccatgacaccgctttcttttccacaggccgcaagctgacagaaggagaactctcctttcccaccctcattaccgccgacgatcccgccaaccgggcactcctgccccccatactccaaatgaccgccatgaaaccgccctccgacgaagccatggcctttcaccttgcctccctcttcttctccatcctctccaccctttttgcccaaaaccgcctgctcccctcagcccccgaccaacacgccctctgcatccgctatgtcaaacaaagcatccgctacatgtacctccacctggacgaaaaactctccgtccccctcctcgccgacaccgccggcctgtccgaaggctactacaccagactcttcaagaaatacacccacacctcccccgcccgcttcctctccgacctgaaactggaaaccgcctgcacctgcctcgcctccggcctcaccgtaaccgaagccgcccaaaaagtaggcatagacaacatcagccattttatccgcctcttcaaacaaaaatacggtataacccccaaaacctatcaacattcctattgtttcaataataatcccccacagaattaaacagccccctcccactaaccccctttttcacttactcccccaaataacttataacgttcctgtttaagccccgcccatccggcctgtgcctgtgccctccggttcttgtccggttccggcgcctgtgcgggccatgttatttcacagtgaatctgagaaaaagatgatatttcttactgctctgttttttctgcctgcggtccgcccttagcggcgctgtttgacgaccgcagggaggagttcagccgcgttgaccgcagacaggaaaaacagaacagttagaaatatctctttttcgaagctgaacagtgaaataacatggcccgcgcaggcgccggaaccggacaagaaccggagggcacagacacaggccggatggatgggcggggcttaaacctcaccacctaaattattttatttccgggggcttgtaaattccagtcaatccgatagactgaaggtaagatttaacccggccggttaaaccaaatcagtcaggaggaaacgcccatgaatgaacaattttttcatctgcccgaagaaaaacagcaggctatcatcaacgcatccctggaggtcttcgccacacacgaatacaaaaaggcctcaacagatgacatcgccgcaaaggcaggcatttccaaaggactgctgttctactattttcataataaaaaaagtctgtatctttttctttatgattatacgaaaaaaattgtaacagatcaggtagtagatacccattttgacgagatcaccgatttttttgagcttctttcttattctgctgaaaaaaaggcggctctcctgtcacgcaatccttatatcatggattttgtaatgcgctgcttctatccggaaaaagaagaagtatccgactctttgaacagtaccaaccaggaatatattgacaattctattttctggtattttaaaaatgtggatttcaccaaattccgtgatgacaccgatccggaaaaaatactccggatgctcctctggatgaccgatggatatatcagtgaaaaacgcagacagggtaagccttttgtactggaagagatcatgcaggatttcggggaatggagtgacatgttccgcaagatggcctacaaggaggaatttctatgaatgctgttcaaatcaatcatattacaaaagactatggtaattccagaggaatttttgacgtctccttatccgtaaaaaaaggagaggtatacggtttccttggccctaacggcgcaggaaaaacaactacaatcaggcacctgcttggttttctgaaaccggaaaaaggggaatgcagaattaacggaatggactgtttcagccaggcttccctcatccagaaaaacctgggttatcttgcaggggaaattgcctttccggaagatttcaccggccacgggcttctgcattttcttgcggatatgaagggtatccgtgacagaagccggatgaaggagctgatcgacctgctggaactggatccttccggcaaagtacagaaaatgtcaaaagggatgaaacagaagcttggaatcataaatgcttttatggggaatccggaaatagttattctggatgaacctaccagcggcctggatcccctgatgcagaaccggtttattgatctgatattggaggaaaagaaaaaaggaaccaccattttcatgtcctcccatctttttgaagaagtggaacgcacctgtgaaaggactgccattatccgccgggggcagattgccgcggttgaagatatggaagggctgaaaaagaaacgttcgcgggactatatcattaccctggacagcaaaaagagcgccgatgccctgcagcttcccggctatacgatcacaggccgggagggtgccagcgtcacggtagccgtcaaagaggatatccccgggcttttatcgctcctgtcctcctgtcctgtacgggatatgcagatccatacccagtccctggaagaaatcttcatgcattattatggaagtgaggtataaaaatgatttcattgccgctgctgaaaagaaatatgtcacagacctggaaaatactgctcatccttctggctgccatgacattatatactacggtcatcatttacatgtatgaccctgagctggcccatatgctcaacgactatcaaatcgctctcccgggcatcatgtccgccgtgggaatgacggggatcgccggtaatctgacggaatttgtatatatttatttatacggcttcattatgtttgtgtttcccattatcgccatcataatcctcggcaacaagcttctggcccattacatagacagcggttccatgggcgttcttcttgccacacccaattcccggctgaaaatcctgcttacacagctgctgtccatgctggcaggcattactttactgatagtcctcatcacggctatcggcgtcggcacctgcgaaggcctgtttcccggagaactggatattcccttattcctgaagcttaacgcagctctgcttctgtttcacctgatgctgggaggcatcgctttcctgccggcctgtatttttaatgattccaaatggtatttttccattggagccgggctgctggtcttatttttcctctttcagatgctggggaatacgggaggcgatatggaatttttccgttatcttaccccttttaccctctttcccggaaaaaatattgtggatggcgatggggaagtgctcctgaaatgcctgggtatggccggagctgccatagtcatgtatggatgcggggctgtttgtttccataaaaaggatttgcctctgtgaccacttttaaaaaggaagcatcgggatcaccgcaaggatgaagcaaaccctacgaacttaaacaaataatccaaatatcttatagcccctgcaataagaggtttgcaggggctataattatgtatcaggatattccagttgtttctgtatttgcttttatcagttatatcttatattataagcataatttaattgtagttcagttatactatatgatataatattttagaaaggagtgacagttatgattattcgtgagtcttacttatccaaaatccgtccatttatcggaaaagacattatcaaagtattaaccggtattcgccgcggcggaaaaagtgtactgttagaacagattcgtgatgagattaacagccctaataccatttttctaaatttcgaagatttgggcaatcaacatctatgtgaatatcactctttacacgaatatgtatgtaataaaatcggcggcagcaaggagactttctacttatttttcgatgaaatccaggaagtgcagggctgggagaaggcaataaactctctgcgcgtaaagttccatgcagacatttatatcacaggttccaattcacagcttctgtccggtgaacttgccacctatatagcggaacgttatgtttcttttaccgtttaccctttttcctttacagagtttaaaatagtaaacccggattatacctttgatcaatatattcaatatggaggcatgccattccttgccagtatcggctttgggacagaattcagcaagaattatctgcaggacatctttcattcagttgtgctcaaagatattgtcaagcgcaacaatatacgggatgtagaccttttggaacgtattatcgcctatgccctagcgaatgtgggaaaaagtttttcagctacaagcatctctaagtttttcaagtccgaaaatcggactgtcgctcctgaaacaatccttaactatttgaaagcctgtgaggaagcttacttgctgtaccgcctgaagagccaggatatcaacggaaagaaaatgctgaaagtaaatgaaaaatattatgtcgtggatcacggcttacgggaagcgattataggagagaatctgcaaaacgttgaaattgtccttgagaatattgtagggctggaactcctccgcagaggttataaggtctgtgtcggccgtgtcggtgaaaaagaaatagattttataggcgaaaaagatggagacaaactatacatccaagtatgctatctgttgattgatgaatcgaccatccaaagagaattcggatctcttctggagattagagacaactacccaaagattgttttatacaaggaaggctcgttcaggggcaaatttgaaggcatccccgcagtcaaaattgaggactggctgtaaaaaatacgggcgccagaatatcctgcatacagcaggaagttatcctaatgctccatccggccagaaatgctactgacagcagcacttctggccggatggagcattcgcgccttgggaccaaaatggcccataaaggacatatttcgtaaaatgtagtgaatcctgaacttttataccggagctgtggggtttattctggcatccacatccgccatcactggtatagataccgcagctccctccctggataccgtaactgccgccgcgcaggccgctgttttcattgcctcctcttctgtcttcccgaaagctgaggacgcgataaaataaccggtaaaggtgtctccggccgctgtcgtatcgaccgtttccgcagggaagcacggctgcttaaaccgcttttcgccgttctgatataaggctccatccttccccagtgtgaggatgacattcatccggggataacggcccaccagcgcatccgctatgcgggccgcctcactctcaccggtcatttcctttccttccgtctcattcagcatcagccaggttacccccgacaaatccatgtttctcagattttcatccatgggagagggattcagcatgatccgcagtcccttctcttttcccctttgaagaagataatccagattgctgatttcattctgtaaaaggagaatatccccttccgaaaaatccttcagaacatcatcgataaacgccctgtcattctcataattgctcccgttaaaaaggatgatacaattctctccttccccggaaacctgaatcagcgcatggcctgtaatctgcccgctgtctctgagataacaggtcttcactccgctctgctccaggatctctttcaaaaaaaggccgtcttttccgatggttccggcatgccagatttccgcacccgccctggataccgctatggactggttcagccccttccctcccgggaaacactcatagcccagggaagaaatcgtctcccccggcctgacaaaatggggaaccttatataccttgtctatgtttaatgacccaaaattcaatatcttcattcccatacctcgccgtcaggattctgccagtttacggaacaaatcctcaaacaggttatctctgttaatatggtacacatatcttatgaaatgcctggtgggatcaaagctgtaatgatgatcatactgcggaatcgggctgggtatcagtttatcctccataaagctttcatccagcagccatgcaaccgcagtcacatcccatatcactctggtccagcagctgtttttgcttcccagcgcgccttctttttccgtataatccaccagataatcgcacagcttgttctttccgcgcaggaacatttccagttctcccgccccggtggtaaaagaggataccacgcccatgcagggcagctgtaccagcgctacgccgcatccgaaaaccacacgggcagcagccacatcctgaaagaggttgaattctttattgtccggccattccagggaatttcctcccagccagacaagaaccatgcgctccttgatttcaggccgcatgagcagtgcggatgccacattggttatggccccgatagccacaacgtacaaaggcttttccggcgtatactccatcgccagttccgtcagatggcgggcagcggcggattccacaggggtctgttcatccggcagatatccggcggaacctttatatacccgttccttatattcctccttctccagcagcgtgaggatatgaaggatttcctgatagctcttttccataccatcctcagggcctgtggatttctcattgaaaaaaggagccgcataaactgcctttaaatgcagcttgtctcccgattttacgagataagacaacgcatactggtcgtcaatctcattgtaggtatccgtatccagcaccacatccaccggaccggcaggtttgttaagacgattcaataaccccaaatcattattcattcttatacctcctgtatatcgcaggttcgcctgcgatactgccttcctgaaagcgtaattacttacccatatattatataagttaatttggggaatgtcatttaaaatttatgactttctataccggattttgttgcagcaaaaggctttaccctttcctgtcctccttgacaggaatatctgcaagccttaaaatttgtatggaactgtttattcgggggaaatagaaaatgaatctgaaagaacgggccgcccggctgaaaacagatataccggcgattttcctgtgcttgaaaagtaaagaaacgccattgattccaaaaattctcgcaggcgtgactgtcgcctatgcgctttcgcccattgacctgattcccgactttattccggttctcggctatctggacgatttgatcattcttccggcattcattgctcttaccatacattttattccgaaagacctgtttgagcattaccgcaaagaagcggaaggaatgtgggcagaaggaaagccccggaaatggatttacgctttacctgtaataatcatttggcttttgcttttatcgcttattattaagattatttttttctgactgcttaaaatttatatctgtaaaatttaaaacagaaccatccgccagtataaaaactgccggatggttctgttttatccgatcatcatatctataatttcccggtctgtttccctcatgccgtcacgtcccagacgggctatattggctatggtggactccacgcccttttttacaattccgtctccgtccacgaattcctgcccgttacgatacatatagaagcccaggataccggcatctacggcggatgcaattttagcggcacaggaagccttcgccccatcgcatacgattcctgatacatttgccagtgtatttacgatggtatggacgatttcttcatacccgcctcccataagataggcaatccccgcgcctgcacctgtcccggcgctgactgcgccgcagtaagcggataaacgcccgatgccttccttcagatgaatggccgtcagattggaaatcagcagcgcccggtaaagcttctctctgcccgctcccagttccgccgcgtattcaatcacgggaacggatacggttattccctggttcccgctgcccgaattgatgaccacgggcagctcacagccattcatcctggcatccgatcctgccgccgccttggctcttgcacggatttttacatcatctccataggacgcaagcaatacttttcctatgtttgcgccataatcatgcttcataccttcctcggcaattgccatgttgtatcggatctgccggtcaagaagctcctccacatcccgaatgtccgaagtcatcgcaaaatccaggatgccttctatggacagcaccggccgttcctcccgcgcgccgttctcatgggctgtttcttcctcttctctgagaactctgccattcttttctatatgcaccacattagtgtgggaatccgctatctgcaccttagcctcccggactccgctccacacagttacggtcaggtcaaaggtacggcagcccccggccttctgtatctgaatctctgccttcttcagataatcccggattgcctgctgatcctcccgggtcaattcctctaacagttcaagcttacgctccggatggccggcgacaacacctgccgccgcagccgtctgtatccccttcattccgccggttcccggaacaatgacgctcttcacatttttaatgatatttccgctggcttccaccctgattttttccggcatttcccccagaatatctgccgcaagagcggtcccataggcaatcgctattggttccgtacacccaaacgccggcaccagctcccgttccagaatctgaaggtattccttataaacactgctttcccgttccatcttttcctttcttcccgcttcagacttcttccgaagcctgacatatatcaatttctgtttgtctgcagatctcccgccttttcacccttacatgcttctggcagtttccagcacccagtggatatgttcaacaggcaaatcggaaggaattgtgcagtctgcgcctaacagaaagcctttttttccacaggtttcaatcaattctctcgtaaatttcctgatctcttcttcctttccggaataaaggataccttccttacggttatcaaatccgcccaaagccggttttcctgcaaaaaattgtctgccggagggaatatccatatcctccacataaacagcccagttaatggctgcggcctcataatcctgccatacctcaacccggttcttatctccgccccagccgcagcagtgaaggatattatgggtactgagcgtattcgcatagtcaagcacgtccttatccgaaggggtaaccagcctgcggtattcttccgccgtaaaccggaaggtttccgcattctgcacacaataataaataccgtcacagcccgcttcttcgatcagccctttcaccagtgcctttgcgtcctgtgcgatcacgctgcaggcatatttcatggcttccggatccgccttcatgcattccatcattttttcccagcttgtctggagcctgaaaaaggacaagggacagaaaacgttataaaaaacacagcattccccgtcagccgccttaacaattgctgcagcacgttcaatctgttctctgataaaaggatgattttctcccagaggcttcattttatatagctccgatacatccgcaagcttctccaggatttcgttgggatagccgaagtaaccatcacacataatcttgataaaatcctgatccgtatcccggtaccattgcagatgggcatccacacatgcctgaccttccgctttatctgcgggaaaatgaaaccaaaatgcagccggtacatgatctgtctcccggttctccaacgccgccagtactctcaattttttattcataatgcttaccttcctctcagtttgtacttttattatagaaattatctcttccttcttctataacctattccgccaaaaactgtgcagattcaatcattttacttttattgcaactcaaattcggtaaattctttttgccaggcatgcctgcatagattataataaaggtcagataacggaatttatccatggaggattgtattgcaatgaaaaaaagaaagaaccagacccttttctctcctgcgttggcatttgtgctttgccttttattctgtgccgccattccccttcccttaagcgctgcgggtatacagggaacggacgcatccgattccagcagaggttcacatacctcaagaaccgctgctgccgtaccgcaggcagatcgcgtcacttatcaggagggctttttttatgaatccttaagcgaagaaatcaaggcccgcataaccgggatttcctatggggagggctgtattgttccctatgaagatctgagatatctgcatgtgctgtatatagatttccagggtctgccccaggcaggtgaaatcatttgcaataaagccatcgcacaggatttggcggaaattttctatgagctttacctggcggaatatcctattgaacgaatccgtctgattgatgagtacgacggggatgacactgtgtccatggaggacaataatacttcctgctttaattaccgggtggttgacggcacatcaagtctgtccaagcacgcctatggcatggccattgatattaatcccctgtacaatccctatgttacctatccaaaaggtaaaagaagggtttctccggcggccggtgccgtttatgcggacagaagcaaggacttcccttataaaattgataaaaatgacttatgttaccagctttttacggaacatggcttcacctggggcggcagctggaaaaccatgaaggattaccagcatttccagaagagcctgcctgaaaactgaccttaacggaggaatttatggatattcaactgcattatgtggagcagggaagcggttttcctctcattcttcttcatgggaacggggagcattcaggctatttcagtcaccagatcgactactttcagaaaaaataccatgtatacgcattagatacgaggggacacggggcatcacccagaggaaacgctcccttcacattggaacagtttgccctggatttgaaagactttatggatgaaaaagggattaaagaagcggatatcctggggttttctgatggagggaatgtggctctactgttcgcgctgaagtatcccggaatggtgcgccgcctgattctcaatggggcggatctttttcccggaggcgtgaaacgctccgtacagattcctattattatcggttacaaaatggtatccttcttttccctttttgataagaaggttattgcaaaaaaagaattactgggacttatggtgacgcagccgtccatcgatcccgggtcgctgtcttctctgactatgccggtgctggtcattgcaggaactaaagatatgatacggctgagccatacacagcttattgcccgttctatcccggacagcaagctttccatactggaaggagatcactttattgctgcgaaaaattgggaggcatttaaccggagcgtggatacattccttacggagcgggaatgaaatgttttactaaaatataaatttaatcttatcttaactgtaccctcctgtatgtaaatattacctgaaatgcaaatttggggccctatgagcgtaaagtaatttctatcagacaagattatatgacattctgttgtcaagtttagtgtgatatatttttaatatattacccctattataaggaggtctataaatgtacgatacacattattttacacttcataaaacctgcccctgtcaaattgataacgaagtcgtcagaaaaacaaaagagatatttaataaatcctcctgcctgacggacttcgttgccgaaatgcaaaatcaacagattattggccgcctgatttcgtatgataaagaaacaaatactatttttattcataaacgatatgcatgtgaatgcggcggcggccatcctcaaaacaaaacacggattggtgaacggtgccattgcggtcactacaatcactcaaccgcttattgcccaaagtactattgcaagtgcggcgcggaattctttcggcctgtattcgctccgttatttggcgaggatattttaatcgaaccatataaaacagttttgtccggcgatgatgaatgtattatcgctataagaattaatgaaagagaggcaatatgatatgacacacgaggaaaagatgaaattactcattgacgaaaagtatcctttgtcagccaaatatgatcctgaatggatctatgaaaataaaatgggctgtcagtgtctctggcttgtggaatccctgtcacaaatcatgaccttaaaaccaggtatgcgcatccttgatatgggctgtggaaatgccctcacatcaatatttctcgctaaagaattcggagtaaccgtttttgccaatgatttatgggtgagtcctactgacaactggaagcgcatttgcaatgcgggcgtggaaaatttagtttttccaattcatggagaagctcataatttaccatatgcagataatttctttgatgccgttgtatgtattaattcttttcagttttatggaacagcagacaattatttaagcgattatatggcccacctaataaaacccgatggacagttcgggcttgttgtctggggaccggataaggaatttacagggaaagtacctgccgatattggtgagaaatggtggccggacttttattatttccactctttggattggtggaaatggcattttgagaagaccggacttttttccattgaagcaggggatgatttggccggggatggtgtcagagttacacggcaatgggcaaagataatggaaaaatatgataacacacataataacgaaattatgcgatggaacagaatggttgctaaacgcaatagctatcaggcagatgactttagaaattaggcaaagcttccttccctaaataacaggccccgccctccggtttcccggaaggcggagccatcataagccatcctgtctgttttctattttttcttgctttcctgatccaggcgcatggttaaggaaattctcttcttggcaagatccacatccatcaccttcacatccacaatatccccaacactcacggcctccagaggatgcttaatgaacctgtccgtaatctgggaaatgtgcaccagtccgtcctgatggaccccgatgtccacaaaaacgccgaaatcaatgacattgcgcacagtacctttcagaatcattccgggcttcaaatccttcatatcaagaacatcgcttcttaaaataggggcaggcatatcctctctgggatctcttgccggtttttccagctctttcagaatatctgtcagggtaatttccccgattcccagttcctgagccatttttcccttgtccttcactctgcgttccagactggcggccgctgcgctctttccatcaggaatttcctttcctccgacatttcctgctgccgcgctttcttttcctttttcctcctgaagcacagccccgcccatggccgctgccaacgctttccccatggctgtgctggtattgcggatcactacctgtttctgcttctgaggcttgggctttgcaggagccgcggcctgctgcttcagcccggccttcatacgctttgattccgcctgcagcttcttcacatcctccatggacagatccagcctgtccagaagcttcatggtagcttcgtaagattccggatgcacactggtggcgtccagcggattatccccgtccgtaatacgcataaagcctgcacactgctcaaatgccttaggccccagcttagccacctttaaaagctgtttcctattggtaaaccggccgttggcttccctgtagtccacaatattttttgcaatggtcttggaaattccggagatatattccagaagggaggcagatgccgtattcaaatccacacctaccctgttcacacaatcttccaccacaccgttcaaggcttctcccagcttcttctgattcatatcatgctggtactgtcctaccccgatggatttgggatctatttttacaagctccgccagaggatcctgaagccgtcttgctatggaagcggcactcctctgccccacatcaaaattcgggaattcctccgttgccagcttgctcgccgaataaaccgacgctccggcttcattcacaataatatactgtaccggtacgtccagttctttaattaaatccacaataatctgttcggattccctggaagccgttccgtttcccacagaaatcaatgaaatgccatatttcttaatcaaacgtttcaattccgcttttgcttcttccaccttattttggggcgctgtgggataaatcaccttcgtgtccaggacttttccggtagcatccactacagccagcttacatcccgtacggaatgcaggatcccagcccaataccactttacctgcaataggaggctgcataagcagctgttccaggttctttccgaacacggaaattgccccgtcctccgctttttccgtcaaatcattgcggatttcccgttcgattgccggagcgataagccggttatagctgtctgccgccacttcctgaagaaccgggccggtaatcggattctccttcgttattacctttttttccaggaaacggagaattctctcctctggcgcttctattttaaccgtaaggaacttttccttttctccccggttcagcgccaggattctgtgccctgccgctttttttaccggctcctcataggaataatacatttcatacacgctggctgctttttcatccttggccgtgctgatgatttttccttcctcaaaggtgatattacggatatagatacgataatccgcttcatcggatatcgcctccgcaatgatgtccttggctccctgaagcgcatctgctgcggactccactcccttttcatcactcacatattttgcagcctctttttccaaaggctctccggtttcctgcgccagaataaacccggcaagcccgtccagtcccttctccttggcaacactggctctggtccttcttttcggccggaaaggacgataaagatcttctaccactaccagagtctccgccgccagaatcttggccttaagctcctcatccagctttccctgttcctctatactcgcaagaacctgttccttcttttcttccagattgcgaagatagttcagccgttcaaacagatcacggagctgttcgtcattcagcgacccggtaacctctttccgatacctggaaataaagggaattgtatttccctcatcaatcagcttgacagccgcttcaacctgccatctttccacctttaactcttccgtcagttttctaataatatccattctcatacactgcctcatatcctgcaaaatccctgcacgaatatattcacacattcgcagtactttacggatggaaggcttcctttctctcagctactttgtgaaatggcactcgcctgttttccattataattgaaagcgcccttccttttcaagtgcttgatacaaacattccgcataaaaaagttgacttttgagcaacaataaagtatcattattatattcttaaattaatttgtgcagtcgcacattctggcagtttctgccgaaaatcacacattttaaataaggcaggaactaaatggattattataaaataatgtcttttatttctgcctgttaaggaggcatgaatgaaagaaaaaacatggctgtaccgggtgctgagcgcagccggcagcaaaacacagtacgatgaatatgtaaaacgtattctgggaagccggcaggttcttgcacggattctgaagggagccgtgccggaatacagcaggtattctattgacgaaattatacagtggattgaaccagacattgaaatcgcggatactccgccgcagcccggaggaaagaataatttcgatacgaggataaccggagaaaataccgaaagcaaaatacccggagaaggaaccatcaactatgatattcgtttccgcgcttttctgcccggaaataatgagacggaaaaaatcaagcttctgcttaatgtggaggcacagaaaaacttctatcttaaatatcatattgtgaccagaggtatcttttatggcgcccggatgctgtcggaacagctgaacagcgaattcacggattctgattatgatgaactgaaaaaggtctgcagtatctggatctgtatgaattctccccttcacatcggaaatgccatgtctgagtaccggataagcaaacaggatattatcggatatattccggagcaaaaacgctgttatgacaaactgtcggtaattattatttgtctgaatgaaacggacggcaaagacctccgcggaagtctgcacggttttctgaatacgctgttatctccctatatggatattaacaaaaaggaagagatactgacaagggactatggaatgataatggaatatgaattagaaaaggagttgagacaaatgtgtaatctgagtgaagcgattgaggaaaacgcgatttatttggtgaaaaaagtgttgagtttttccgctgaaggtatgagtgatgcagaaattgcagagatctgcggaattacagaagaaaaagttcaaaaaatacttgaggtttaacaactatgcaagggcatgaaatatgaataagttcccttaataagagactgtctatataactgtgtattgtcgtaaattggtatgtacctggttccctttttcggcactccgcgatttggttttacctatgtttgcatgacagttttttccaaaatacgacgtttgtttctaggaatagtattgccgctttccggcaatactattctatttttccctttattttttcttcatttatgatggcatcattggaaccaaatacgatattttgctgatagatcttttcgatctccctttcattgtaaaatccatataacatttccaggaccacctcaaactgttcctccgtcaacggctctctatcatactccataactcgatatgctacacatgcgtatgctgtcgctgcatcatgtgtcataatcccactctccttccacacaattctcttattgatagttattaccgtagctgcaggctttattcaataacaatccggaacaaagcctgcatctgcggtattttgcgttaacaagaggatatgggaggggacggccccctgcacgatcctctcaggaagatcgatcgttctctcaggcgatggatgccctgtcgccgaattcgatgatgaactgtccataagtctctccccaatcccgatagggcatggaccacttttctgttatatcccgcgttgtcagatacaacgttttccttagtgcttcgtcattaggaaaaacggctttattttttgtcactttcctcagctgccggttaaatccctccagggtattcgttgtatagatgaggcggcggatctgtgccccatagctgaaataggtggagaggttttcccatttcatctgccagttctcaaccactgcacgatacttcttccagctgtccttcatcgcctccaggttcctgaatgcgatctcctcactttcggccccgtatacccgcttcagatccttcataaatgccttggaatccttataggctatatatttcatggtgttccgtatttgatggataatgcatagctggatccttgtttcaggaaatacggttttgattgcatccggaaatccctgcaggccatcgatacaggcaattaggatatcttttactccacggtttttcagttcattacataccttcagccagaatttggcaccttcattttcaccaatccagatccccaggatgtcttttcggccttccgcgttgatccccagagcgacataggatgccttcgtgacgatacgcccttcttcacggactttatagtgcacagcatccagaaatacgaccggataaaaaccatccagggtccggctgtaccactcccttgcttcctccatgatcttatccgttatatttgacacggaggccggggataattcaatcccataaagtgcctggacatgggatacgatatcacgaacagtcatccccttcgcatacatagagataatctgtgcttccagcccctcctcgatcacagccctctttttaataacttccggttcgaattccccttccctgactcttgggacatcaatgtcaatgctgccgtaagaagtctttacttttttaggggatgttccattgcgctgcggggtattccccttacttttttcatctgtgatataatctgtgatctcgctttgaaggatctgttcgatcgcatcctttaccatccgctggacaagtccgtttggccccgtgatatcctccatggtactgcacttggaaagttcctcctgataatgaaatcctgatgtcatatcccttaacctcactaaatttatttaccaatttattccacttacatgcagtattgtcagtaatgctgatacctattcaaaaaagaggtgtgtcgaataatctgcaagtgatacacagtttatttgacacaccccttaataattatctgcccctcaaagaacacttcatacttttttcatttgtgtcctgtccgcaaacgtgctacaatagcaacgataaggatccccgtatatttcggggcaaatcccatatcgcagtctgcaaaaaggagattttgttatggataactataataacgggcctatacccccttaccagaataacaattccggttatcctccatactatacaccgcctacccgccatccggggagcagctttgccaccgcttccatgattctgggtatcatcgcaattatttctgcattctttggtacggtatatccgccgattatctgcggaggacttgccgttatccttggactgctgtccaaaggaaatgacaaagccatgcttcccaatgccaaggtaggggtgctcaccgctattctgggaatagtagtcaatgtgcttgttgtgggaagcgttattattatgctttttaccaacccttcttataaagaagatttccacagacagctgaaccagtattccgaatatttttacggagaaagctttgacgatatgtggaatcagatcgaagaaggaacgaatcgctactaggactatccgaaagaggataataaggagtatttatctatggacagacatgcatcatcagctgaacttaaggctaaagccaaaggtcaaatgcttggaaaatacgggactctggttccagccttcctcgtggtggaggcaattatggttaccatcaattttctggctaccttctctctggataccagagccatgacggggcttaccatacaatttgtcatcgaatgcctgctgcagctattggccggtatttttatagcaggacagacctatatgtatctgaatgtttcctgcgggggtaatattaaaatcagtgatgttttttacggcttcaccaatcatccggataaggccatattgatacagcttttacagcttctgctttgtctggtattttttattccgttgtttatctgcctcggcgtttttgcttttactgacagttctctttctgtcatgctgctcttgatttccatcaccttctgtatcgggctggtggggtctaccattataagcttacagtattcccaaagctatttcgttatgctggattttcctgatttcactgcagtccagtgtctgcgttacagccgggaaatcatgaagggaaataaggcacgccgtttttatctgggggtaagctttattcctttgtatttactcggacttcttacttgctgtatcgggctgttgttcgtgactccttatgccaatactactttttccaatttctatctggaactgatgagttaccgcaaccgtcataatctataaaagcgaaaccagcgatgcttttcagggagaatttgctatgacacccggtaataagaacctccccatcacatacagagaatataaatttgcggaggagttccccattcttctgatggaagggaaaagtacctctccgcagattgactttattcattttcataattgcattgagatagctttttgcagaaaaggaactatgacgtggaatctggagaaccggatattttccctaacaccgggaaatatctgttttcttccgccgtttttcacgcatggttcctttttcccggttctgccggaggccgctcctaaggagactgtaccaaaagagactgcaccaaaagaggatgggcttaaggtggttttttcagaggcaaaggggttttcagaggcaaacatttcacccggaactgatacaacggaagatgccccggatacggatgtatcctgtgtctatctgttttttaacccggaacagctgctggcgcccttctatccaaacggccttccccgggagttcacctggtaccagtatacggattttcctaaaatactgcctgctgcactttttcccgaacaggtaaagcttatccgcatgatcatacaggaactgcaggagaaaaaagaacattaccggcagtccgtccggggtatggtggaaacccttcttatcctgctttacagacagcatctggactgtcctgttttcggaggaacggtttccgcacttcctcagctgtttcctgccgtatcttttctggataccgaatatgcttcggagcttgatacggctcatttggcccatttatgcggcctttcccaaaggcagttccttctgtattttcaggaatgcttcagccagacccctctgcagtatctcaggaccgtacgaatccagaaggcctgccggcttttaacaagtacggaaactggcatactggatatcgcactgcagaccggctttcattccctgtccagctttaacaggtattttcacaaaatagtagggagcaatccccaggccttccgcaatgacagacgtgtcattgtcaaaaaggatcccagatatgctccctatcacgcagaataaaagaatccgctgccatttcctccctgttgttattcggaggctgtaacggattcttttaaccggtccgaaattctgtccgtctttctttcctttcccgctcccattgtctgagggcttctgttacccagcaaaaccgttccgtctcaaagtccgtcagaaaggaacagtccgcaccgagtatcaggccgtccgtactgccgaaagcattcttgtaggtttccaggatattcttggtttcccgccggatttcttcctttgtcccggaatacagcagctttccccgacggttgtcaaagccgcccatacagttgcgcatgccgaaatattttctcccctccgccaggggcagctgttccacgtaaacagcccagttaacagtattccccggataatcacgccaaagctccagctggtttttgatttggttccagccgcagaaatgaaggatgttataggaagagctttcctgtgccgcggacagcaccagctgttcggaaggcgctatataatctgcaaattcctccggggtgaaaagaccggtttccgctccctgcatggcgagaaaaataccaaggcagcctgcttcctgaatcagcttttcactcagatatgccagatcctctcccataaaaagcagggcatccttcatcgcctgcggatcttccctcagaaaccccagcagtctgtcatccccaatccttctgagaagtgtgaagggagaaaaaatattactgtaggtatctgtttcatccgccagggattcattgatccgtaaggcacgctccaggtattcccggatatagggattccggccttttatcggccggtaggcctttaactcttccaggctggtcaggccgagatcaacaggtgccgtcagaccgtcatgcatgatttttaagaaatcgggatctgtctgtttataaaaacggatatgggcttttacacaggcttccccatgcagctcttccggcttcagatgctgaaaaaagctcacgggaatgtgctcatgaggctgtccttccagcatacgccgcagattttcctttttctgtaccatcagcctttcaccgcccctatcatcacacctttttcaaaatatttctgaaggaacggatagataatcagtatgggaatggtggatacaataatggtacagtattttaccagctcactgctgaaggtgtcctccacggcagcgatcagggaatccgcattctgcgcctgattttctatgagaatttccctaagtatcatctgcagagggtatattttcctgtcccttgtgaacatggctgcaggaaaccaggagttccactggcccactccgtaatacagaatcataaccgcaacaacaggcttggacagaggcatgatgattctggaaaagatagtaaaatcattggctccgtcaatgactgccgcttcctccaggctttccggaatggattcaaagaatgttttcataatgatcatgttataggcactgatcgcataagggatactggatacccagatggtattataaagccctgtattcctgatgacaaaaaacaacggaatcagcccgccgctgaaaaacatggtaaatatcatcagcttcatcactcctctgcggatcaggaagcattttctggaaaccacataggcggcaaagctggtcagccccacctgaagcagggtacccgctaccagataaaacagtgtgattttaaagccattgaacaggcttttgtttgccagggttttctgataccctgccaatgtggcttctcccaaaggcttccacagaagccctgtgtgggatttcaggagaatcggatcgctgatggaggctaccaccacgtaatacatgggatacagggtgattccaatcaggaaaatcataatcaggacatttacgacctgaaagggttttatttttttcttcataccgcacctctctttatcaacatggactctgctctcaccaaaggcttgtttcattcaccttccggctcacggaattggccagaatcagcagaatgaaattaatgatggagttaaaaaatcccacggcagcagcaaagctgtattcaaaattcatcagaccaatccggtaaacataggtggagataacgtccgctttttcataaaccataggattataaagaagcaggattttatcccagcccagagtcatcatattaccgatacgcatgatgagcagaataacaattgtgggagaaataccgggaagggtaacatggaggatttttttccagcggttcgcaccgtctatttctgccgcttcatacaggctttggtcaatacccgtcagcgccgcaaaatagataatggaatcccagccgaattcctgccagatacacatcagcacgtacagcggctggaaataggcggagtggctgaacatattggaggcttcctggcctgtaatggcggtgaagacactggtgataacgccgttggttttgcagaaatccagcataaggccgcagataaccaccgcagaaataaaatggggcatgtaggtaattgtctgtgtgattttccggagtctggtgccggtcagttcattcagcaaaatggcaaagataatcggaaagggaaatccgaaaagcaataacagcaggtttatggaaaccgtatttctcatggtacggaagaaataaggatctcccagaaaggctttaaaatgcttcagccccacaaaatcgctgccgaataccccctttgtaggaacataatcaaacagggaaatgatcattccatacatgggatagtaatgatacaccagaaaatacgcaagaacgggtaaaatcatgatgtacaaaaggggatgcgacctcatgtttttccacagcttcttaaaaaaagagtctttctgcgtcataaccgcacctcttttcatcgttgctcctctctgcgtgcgccggcacgcatataaattcaaaggctggctttactgacgccagcctttttctgcattttacagggttaaatcctcttactcacgggcttcatatcttgcatatgcggctgcattgatttcctctccgcgttcgctgcccaaatccttcagctgtgccacaaagccatcccagcctgtttccaaatcttcctctccaaaaataaaacggtacaccatttcatcggagtaattggcaagtttggttttgatctgtgtcagttctttggattcttcagtcgtcagtgtcaggtagccgggaagcgtatgcttgtcatcattctgactgccccatgcatcccatgactggtggcactcttccagcgcatactgagccgcttccatcgtttcatcgtatttaatctggaaaggtgcgcacatgtaaagtgatcttaccgtatcataatccaggccatccgggttgttgctgacaaactcggtaaattcccttgttccgtccgcattttccgtatatgtcttttcttctccctcattggttccccatgcggtaagaagcattacatcaggattcatcagatagtccacgaatttcacagcttcttccggatgcttactggtggcggaaacctgccaggaataggagtttatggagcttgttatcttggacatatgagtggtatcatccgcattcactctcggcatctcgcaggaagtgagcttgaattccggatccacagccgcaccggctgtcacagactgttttacattataggtatgggcaaaacacatacctgccgtaccgttctggaagagcttgagggagtcatcaatcgtacgggaaacgaaatcggtatcgatcaggccttccttcgcccactgattcagaactgtcaggaattccttgtagccgtcctgggttctgctgtaatgtacattgccttcgtcatccagatcgaaatctttgatggacacatcaaaagcggaggctattgggttatttgcataaaactgtgcctggttgaattcgcagagtgcaagcggaatctgcacgccgttttctttaaatgtacgaagtacattggtataatcatccagggtaaccggcgcttccagattatacttgtcaagccagtcctgtcttacgatcaggccattgaatactttgttgttatcggtagggggaagccaggtcgttccgaatttaacgatgttgccttcgtcacctctgattttcttctgaacgtccgggtcaccgctttcttcacaaagcgtgttgaaattcactgcatactgttccaccagatccgttacattataaagaacgccgtctgcaatggctccttctacaccgcctgggtaggtggtctggaacaggttggtatacatcagatccggaagatctccggatgccagaagctgctggaaataagatccgtcatctcccaccggtgcatgaatgaactcgaatttcagtccggtatcctcagaaatcttctgtactacaggattttcgcctaaatcagaataataagctcttgctgccgtctggaaatcgcagaatatggtcagggtcacatccccgtctgcaattttagtgcttccgctctccgtatccgccgcctctgttcctgcatctgccgcttgggcggaagtctgttcctgtgccgttgtactgctttgtgctgtttctgatgctgcgccgccgcatcctgccagcatagctgctgtcagaattgctgccgtcagcgccgcacttgcttttttcaactttctcataacctcttcatcctttctctcttatgctacacacatggttatccacgtgatactgccttttcatggttttacatccagcttgtctatccgcaggattccgcagatatatatttccagcgccctgcgtatcctcagaagggaaatgctttcatccggctgatggtaatcgccgtgtccgggtctgaacaggcctgcaggcggagacggaagcttcaacccggtaccgaatgcaaaggcattgggaagctttcttgcgtaggttcctccgctcataacaaaaggttcctcttcatttttcaggatttccctgcaggttcgggtgagcgtctgtgccaccgcatgttccggattaaaataattggctttggcaagccgggttgtttttaagtcaaatccctgctgttctgctgcttttcccgccctttcctcaaatgggaaatcactgcaggtaataggatacttagacatgaatcctattaccagatgaccgtcctgcatacgcagctgggtcgcggtcagactgatgggaccggacagctcatcttcacagaatacatccagggcttttcctgtactgtcccggttaatggcaggaatgatgcggaataactccttattttcatcacttatcaaatcctgagcacaaagagtttccgccagtaaagtcagtgcgttttctcctgcttcaggattggatgcatgggcagaaatcccccttgccgtaatttgtatggttgctcctgttctctcagcttccagcggaaggggaagacaggatgctttctcccaaagctctttgctgtatgtaagtgtcacctgcgccatatcaggtattgtatagagcccgcagtcacagtgtgcctccagaagttctttcccgcatttcttgtgggaaattaattctgcattaaaggatcctctctcgccgcagcagacagggaaaccgctgtcaggcacaagagatagtgcagggcattcgtaatttctgcaataataatccaaatcaaacatcccctgttcttcacaggttccaaggtacagctccagcccatgctccaggcggatattatgttccttcatatatttcagtacataaagtcccataatggcggagctcttattatcctggcagccccgcgcaataaaataaccgtccttcaccaccgggacatagggttcatagtcccagccctccccttcgtccaccacatccagatgagcccatataccgatactttctttttgttccgaggcatcgtaggaaatcttccctacataattatcatagttctgggtagaaaaaccattttcttcacccatatgcagcatctcttccaggacctccaggcagccctttccgtacggaggatatggaaccgcttctgtttccgccacgcttcggatacggcaaatgcgtgtcaggtcttttacgatgtccgacatcttgtcttcaacccattgctgaatttccggcagaccggcctcatttttattcaggaattcgtccatatatcattctctcccccatcaaaaatcgttcattcactacttttctgtttatgatatatccacccgcatacctttacttttcttactctttccgttataattttccggaaagcaggtagttaaacaaccgcatattactgaacttttatgcactttattacttttttcttcatttattgatttactattattataattatacaaagtaccggcttcctatcattaaggagataaaaactatgcagaaacaatcattccagcgctttcctatccgatacaggccctatgattttcccgcccgttttccggttcttgcttttctcggagaaaactggaccatttctgtggattctccggaatatcttcatttccataacggactggaaatcgggcactgcatccggggaaacgggcaggtgtttatgaccgggcgttctccctctgtttatgaaacagggacgttcagcatcctcttccctcaggttcctcatatggctgtctgcggtacacaggaaagccaatgggaatatatctatatcgatcccatacgttttctggaatcggctgcggactgcggttccgatatctggcagattttctatatgctgcaggaaatccccgtgatcatacaggaggatacttttcctctgctgttttattttctgtcacggatttttcaggaattccacgaaaaaaagcctctgtatcagcaggctgtccatggtcttctattctctttgttttcagaaataaaccgtatcactctcgcggcttcggcggggcatacagcggaatcagaggatgggtattcctatatccgcaatgcccttacctttatatatgggcattatgaggaagctttttccgtacgggagctggcctcccactgctgtatcagcgaaagccatctgcggcggctgtttaaaaatatggtgggaatcagccctctggaatgtctgcagcattaccgtattcagcaggcctgccatctgattcacctgaaccagaagcctgtaaacagtattgccaggcaggttgggtatgtcagtctttccagctttaaccggcagtttcagcagtatatgcatatgtctccttctgagtggaagaaggaacatctgtcggaggcgacggagcatgaggtgcggtcttatgaagataacagtacgcggcatatctttcagttttgacggcgggggagcgtgaaaaacgcatccgccgcagggtctgctctctgttttccggcccgccttttccttcctccccgggcggcggtgggtgtgggttcggatccagcctcaaaaaagggatgtttctaaatgttccgttttgccgggaggctgccaacgcggctgaactcctcaccagcgactgacgtcggctggttcgtcagacaagccgctggtacagcattgcattaatattgcagtaatgagtgcttgatattcctgtcagcacaaggcggaggagggaggcgatgcggtggcatcgttgaccgacgacaacgcggtgctggcgggaatagcaagtgctcattactgtgatattaatgcaatgctgtaccaggggcggcagtctcccggcaaaacggaacattaagaaacagtcacctttttttcccatgggtccgtacccacactcaccgccgcccggggaggaaggaaaaggcgggccggaaaacagagagcagaccctgcggcggatgcgtttttccctggagggacattttctgaaattaatctaattaagggatagaaagggccattgtatcacagtagtatttactattgagacgagatttgtcaaggataatttctgcgaaatataatagattcatggaacatataacaaacaaggctttctctgtaagttttcccttcttacaccgctaatgacagcaacggagccaataccagtaccagagggactacgcaaagcacaaacctatccaagacaatttgatgaagctgtaccgggtgaaatctgttgtggacagcgcacgccgccagcaggagcagacacagcaccgggacagggatatggagcggtaaacaggaagatacttcccatttcccagcaataatgataaaataaaattggaagtttaacaccactctcacctcaaatgggacagaaacgtgatatggagcaaccgaaatatggacaatgtaatttgtttgagtaaccagataagtgatcccccaaattttccacgatgctccagacatgatacactgctgacaacatttggatgccagatctgcaataatgaaattcttaaatgatgggaggaatttgaggaaaatggctgcgaaatttgaagtttacattgcaagcaaaaaatatcccagcattaaaatgtgcgaaacgatatttcctattgtcggcaagatacaattttcagaaaaatgtattgtttggaatggctggctgccaacaaaagaagatgtgctttacacgcaagatgatgaacaaattgaacggtgcgtattaaatggcaaagtcgtttctttcgatggaaaagcaggctcttatatcattggagcaaggcaatactttgaaaatggagtattttctactgaattatggttcgacacatcttatttcccggaattagatgccaatatatcaaatgaattttgcaattctttttgccagttgaccaaacagaatatattggggctgtgtatagtggcagaaattaaattttttgcgatggggacagagatgtgtgttgattattctgaacgattggatgagagtatcaaaaaaagtcacaatgttatgtgctattggagtaagaaagccagcagggactaaagagcaattaccataaaccaagcacaggctttaaggagggagagacgatgacccacaaaggaaaaaggcggctcgtgatatttttgtgcgcggcggcggttattcttgtggcggcggggatcgttcgggtcaagctgcacccgccccgtccgctccatgagcagatcgcagattatatgtaccattcccgtacagacccaaagctggaatacctcatcgagaagtatggcgatgaatttgttgcgacagagtacggaagtattcaatccacacgatttccggggctatatgtacgtttgagatggtcggaggaagcgcagacatatacagacaactatattgtctatttaagacgagaagatttgcgagctattttagcgcctactgtgcaggaaatttacgatgattgcaaagtatttattgcaccttacaccccatctcctgactttgataaaaacactacggctgaagaattactcacaacttttggtatgggacgaaacccggtcgtttctctttggatttatacgaaagatgatacagtaggaaaagacacagatatgcagcaattaacatcaaagatacaggcgatgggctattctgtagatgtaggtgtctattatctatcagaagaaaactatgaagtagtcaatgaggacgattatctcaattataatattggtgcgcatcaagatttttatgaatattttgagaacgtttatatttatccagacagttttgaactgattttaagtgactggaaagaagaaagcagcaaatagcactacacgcccccacctctggacactttgtccagccagaaacggaaaaccgaacaccacccaccaaggcgcggcagacaggccgcgcctttcccataccccaaaatgaatacgaactatccatgattataatatttttggtattccggcagaataccgtattcattggtaataacctctttggagaggggctggtcgaacgggacagcgaggtatggagagctctggaagggttttcttccttgccagagctgttcatataacttccagcgttctgccgtcatggagtttggattgctttgatcctcatgcttccaaaattgtccgcccagaagatagctctccatcatttcttcccagttctgaaaaaaagcctgcgcctttgtcccagcatctacacacaaatccaacatttccttcatattgatgtagcctgccagatagcaacattgcgtgatatatgcgcagcgtcccatatcccagcctaacagggcattttccccataacgccgccatgctgtcagcattttcggcaggtagctatcttcatcggcttttggattagttttgcgggcctcctcaatgagctggacttctgtagcatccttatatttatgcgacaagagttccattttcctccgatagctggcacgcattccctcgtcgatcaggctgcgcatttcctttatagctgtctcatgtccttgaatgccccaataatcccacagcattgttttaatactttcccggtcaaattcgttattgtaccgccagccagccagtagatgaaaatttgtatgttgacttgctgcaatcaggatcgaccctgcggcattcatccagcgcaatgtaggggataggggattatacttctccatccgtctttgcttcgatttatagatatgatacagaataccggcaagaccaagccctatgactaaagtagcggccagggcgataaaagccgtcatatcccctgtcagaaaacagaggatgcctattccaataacaagcaggataacgaacacaatcatgcatcccatatgatatcctcctcctttcagggactgccttcttatttcggactgctttgtccggctctgatgagaatttcctttgcactgcggagaatcgccgtatcgccagcaatcttttgacgctgttcttcaacagggatgtcgatgtaaatatgaaaaggattgcgaagctggctgcaagttacatacagggatttttcagaaaaggaaagataaacatttccttccatagcttcctgaaaagctgtaatctgctccatcacctggggtgtcaggatgtaaaaagcattctgctcgttctctgcaaacactgcaaaattttcgttgaatacactgttttctgtctgaattggcagcgggactctggtttccctgagtttagacagagcttttttggaaaacacctggacaaagccctcactgatcttccgattatcaaaacaggaaaaaacaatgacctgtccctcaaacagaattttgggggtagagcttcttgcggaagctttttcgccagtgcagacattgacagcccggaagggaactccatccagcttgccggacagttcatccgacgattgataaaagaccgactgacctccggggattaactttaaacggttcatttcctcataagaaagaccgcctccggcattgtagcgcaattcggaaaaatccggcagttgtcggagagtgtccaacacatatttgtttttgaaattgatacaaaagaggtcataagcttttttatagaccagcatatagtaaaaaccaaaaatgacacccgcaaaaatcacgctgagcatcaggtttcctaccagcatccaaaaggctccctgagttgccggatctccccatccatattcgctgatggaggcaaacaaaaatcggttttttaccaatgtcaatcctataaacaaaatcaagcataccggaaacagtttccgcaggattttatgttttttaacagcgttctgccgcaaccgttccagcttgacaccgctgatattctgttccaccattttcatacatcttttcccctttcttcttaaaactgcagcttaaagtcttttttcttttcttccacagtgtagaacttcgcttctttcatgccatgaagttttgctaaaagcaggtagggaaatgtgttaattctctggttatacaaagatgcgttagagttgtacaaccgtctcgccgcttgtaagtgttcctctgcatcaaaaatatcctgctggaaatgctgcatggacgcataggaataaagggttgggtattgctcagccagtgcattgatggcagagttgaccccggtgagtccctgctggacggaagtaagcaagccgagtttccgatccagacttacctgatgtccgatcagcccgtcgtcccccatccccggcgtttccgctccaaaagaatgatcctgccctcgctgctgttccaactgccgccagattgtttccatctgcttttgctgttcggcaatcgtctcgctgatcgctttgaccgcttcctcagacagttgtttcttttcctgaaatatgctttcgttcagttctttccccgcgcgggtagatgtgacttcggtgtagatctgatactcatgcgtcagatacttttttactgcctcaatttcttctgacagcatatcgtagcgtttttccaaagcaacatctatgcctgcactcccttcctgcaccttgacgaatagccgcttcagacggttatacatcctgacatagcagagcaccagcagagtaatggtaattactgagattagaattcccatatcctgttcctccttgttttggtattttccatttgcgtatattataatgcaacttcctgccaaaataaagcataaaaagaattgtacaaaggttttctcttattattgaagcagtgttttaccgctcctgctctttgtatttggcttttttctgctgcttttctggctgctgtttttgcttcaggtgttcttgaatagagcgtgcttctgttttttcccccaataattcagaaacatcacgcttgctgtcaaacaggataagcggatcaaatttttctccatatgccgctttgatcttggaagtggcagattgaatcttctctccctgtaagacgatccgctgttctgagagttctgccgaatccacattttttgcctgctcctttaattctgagaactgctttaaggcctcctccaactcagcagcatatttttcttcctgctttgtcagccgtttcaaattttcctccatagccgaaacactctttttaacctcagcaattccagtatcctcactacaatcaaatgaactgaggagcatcgtcttttcggatctcagttcttctaaatcttccgtcagttcggcaatctgttttgccaaatcattatgagcaacaaactgataaaatggtgtcgctttcttttctgtaagcagcgttttccgttctttggtcgtatttttaatctgctgtaccagtacggaatatcgctctaagtcgggcttcagcacattcaggctttccgataatttgtgctttccaaaaccggcatagcgaatctgatagcaaaaaataaccatgttcgcccgtaaggactccattgcttctgcaagagcaggaacagatgctttaactacctgaatcaacttcttgaccgttgctttcagctcacggagcaacgcattgtctgccttaatctgacgatttaactcacagcggtcagaaacaattccctttttctccaatgctcttgcaaccacaccctcgtgaatggtgggctgttcgctcaagcctcgatctgcatggctgcggtggtcaatgcgttctttgtgtccagcacgctccaaatggcggttcgttacatccgcccacgctgctctccataaaacaagttgttcttcgctgttccaacgctcagcaataggattttgtctgccgtatttcgtgcttttgggatatttcgatacccgttcatagcctttttcttcagcagcagaagcagtcatataaacctttttctttcctaccttatactggtattgcttttcccatccctctgtctgtgccgtcttaaactcatccgcagtaaatccttgttcctctccatttttcacacagagatattccttctgtgtcttatatttccagtttcctttttcatctaacgggcgcactgtcagcatgatatgagcatggggattgtgaccgggaggatatggatcatgaattgccacatccgcacacataccatcatctacaaaggttccagaaataaaatcagacagcagcttttcccactgtgtttcgttcagctcaatcggcaaagcgaccacaaattcacgggcaaggcggctgtcttttgtcttttcattttcttccacggcgttccaaagcacgctccgttctttccattctgatggggcaaactctggtaggaacacctcctgccaggcaagaccttttttacgggtgtaatcgtgctgaatcccgtcatagtcattcagtattttagaacaacttaaatacgctgccgcagcgactgcacttcgccctgcaccacggctgactatttttgcttccagatgatagattgccatttggcttcaccgtcctttctttctgtttctcttttgaaaagagaaaatgggtgtcgccgagaatgcgatacccataactgcgtaaaagctgccagtggcaggttttcgcaggcaggcggcgagatggggtggcaatatgccacctcatcgttttgctgatagagcaaatatagagccgactgcacagggaatgttcgcttgcgacattgcctgccccctctggagaactgtctgaaagacagttcgtgaagagcgcacgagcccgaccaacgggagggataccaccgcctgctttgcaggtggtgagtaagtgcgcccttcgggaaaaagaaaaagcgaccgatagccggtcgctcataaaaatcatcggattggtttgaatacttcgcataaaaaatcctccaactgttccaaagtcatctgtgttgtctgcggtaatgctttctctaaaatcgcaccttcctgaaccagccgccgtgtccgtgcttttcgctctttctgtcggtcacgcatctcggcttcttccaatctgtgcttcgcctgtaaaagcttcttttcattttctgtcataggttttattcctttctgccgtatccggctgaaaacgcaaagaaggcggctcatgagattttattctcacaagtcgccttcagcgtcatttattatgctgttttctgtttttgcccgttttctttaataggcggggcatcaagcaatactggttcgttcttttttatttgcttcgcaacattgcgttctttctgcatcctgcggtttgcttccgtcctgcaatcatcacaacagtattttacatctctccgtgtagcggtaaaagtttttccgcagttctcgcagacacattcccgctttcggttttccgctgcttcctgacggtaaaatttagtacggcacttcggactgcaaaacagagtatttgaccgcttggattcaaattcttcaccacagcatttacagattagctgaaatggctgaccaactgcgtgctcaccagccttgattttttggtagcgttcccggctcttgatgcggtgtctgcgaagctgttcctgccgcttgatctcctccggtgtcagatccggttcgggcagttcaaaccgtccgataaatttcagataaatctcaacctcctgcacccgatccccgtcaatcttttccggggcgtggacaatgattttttcaataaactcattgatcattggagtagtcagttcggaaaagtcggtgtacttctttgccagtgaaaggaactgctccgcacggtcagtatcttcctcaaaagaggacagatgcgattctgcatccgatacagatgtgacaagagctttctgctccgcttcgtattctgcaagcagagtatcaaagcgctcatcggtaatgcgcccaatggcaaaagattcgtagagctttttgataatggtatcaagctcggcaatacgcctacggtctttgttcaacttgcgtttggtatcctttgcgacttccgcctgtctgatttgagaagcagaacgcacctttttcataaactcatcctgattggcgatggcaaaggcgctggctgttcggatggtttccaaaacaagctctctgaccgcttttgtccgaatatagtgaccgctgcaagcatgagtgcgcttttgatgtgccaatgtgtaggcggagcaatcataaaaatcagagggatagggattgctcttcgtaccgcctttggaacggtgattggtcattttcgctccgcagtcagcacagaacaaaagtccagtcagcggattggcttcgccaagcgtatcgtggcgtctcggtgtctttcgcagtttctgtgcaagctcccacatttccttatctacaatcgcttcgtgggtgttctcaaaaattagccagtcctcctgcggattcataaccggatttttgtccttgtaggactgcttgtgagaacggaaattgaccgtatgccccatatattcgggcttggagagaatctgcccaacgatataaccactccagttataagggttgggaaattcctctttacttttccagacgccacgcccctgctttgcggcgtagaccgcaggagtttccaccttatcgtcatagaggatacgggcgatgtcataaggaccgtttccctcgatggtcagccggaaaatgcggcggacaaccgcagcggcttcctcatcgatataccaactgtacttatcacccggcattttcttgtagccataaatggcacagttggtggtaggcttgccggattcgcctttcacacggatcgctgttttctgcttgcggctcaaatcacgaagataccactcgttcataatgttgaggaacggggcaaactcattgctgttctgatcgtcgctgtccacgctgttggcaatcgccacaaagtgaacatgatgctgacggaagaatacctccgtgtaaaagcctgtttgcagataatcacgccccgccctgctcatatcttttacaatgacatgagcaactttgcccgcttcgatgtctgcaataagctgtttccaagcgggacgctcaaaatttcctccactccaaccgtcatcggtatagtgctgacagttcgtataacctttctgatgggcatagctttcaaggtattttttctgattgacaatactgttgctatcaccagtctggtcatcatcacgggacagcctttcatataaagctgtgatttttccttcagtctgttttacgctcatgatgcgctcctttcagactgtcggctcatttgtggtgaatctattataccacaagttccgccagttgtaaccgtttcattgcgaatcatccgtaaaattttatcctccatcgtttccttctctgtatcactgaatactactttaactttataggtggtgccgccaatgcggcgagtcatataagaaaaattactgttctcgttttttgccataggcagttacctccgtgttgaaatgttcattgttttttcgtataataggtttagttccggcacggtgtaaccatttgcatggttaaaatcgagcaaaaggtattcacaccctgccaatacagaaatgccctcaaaaaagccttgcggcacaaggctttccgagggcaaaagcgttacatctgttgttgtttctcccgatacttacgcacccttgctgctgtctgcttacggcgagcttcttcggcacagcgctgtgagcagtacacccgttttccgtcagttgggaacggcttgccgcattgtttacaatgagtggtcgatatttgcgtgaatacggcttccaatcctgcatcttccggcaggacagacttgcggaaatatctgcatagtgcgctgttggtaaagcagatacccaacattggacagtcacaatccaatggcaggcagccgtactctttgtcgtagttggcacagagagaagtaaccagcttcttgatccgctgcttctccctgcccgtcagctcacgataattgtttgacataggcggtttcctcctttcattcagtgtcgaaagtaatctaataacaggcaaaataggttacatcctcacttataggagaaatacagggtacttagcggaactgtttttatggagaatccaaaaaaatttcaaaaatatttttgaagggaggtgtctgcggtgtttgacgatcccgaacgatatgaacatgacggtttttatgaagaagatactgactatgaagatgaatatgaagcggacgattccgattacatagtcgatgacgaagaaaatgaaaacgccctttgggacgatgaggaagaagaacccgctgacgatcttcccgaaaagaagcgaaggaagcggaagaaccaagttgttcttgctgacaatgatacagataccgaagaaaccgaattatccgaacaggtcagacggcagattacaaaagaaaaacagctcatcgaagaactggaagccgacgccgaggaacatccctttgaggatggtactgacgaggaagaactggagcgtaagaagctcaaacgagaactgcgggcagaagcccttgcacgattggaggattccgccagaacacagcgggagtttgaaaatgtgattgcatggtgggacaggctggacgctaatcgggagcgtagggaacgctatcatgaactcagcagaagcggcgatgatgttcctcttgattacggggcatctgccaatgaactcttttttccggatacgctaaatgatgtgctggaaaagcagatacgaaaaggtgatttcattgacgcaattttctactgtccttacgatatacatgaacttgtaacggaagaatacctatccaaaattctctgggaattgactgaggaacacaaagagctgctctttctctgtgctgtccggttgtttagctcaataaggatcgctaaaatacggaatcaaagcgaccggaacatccgcaaggtgcgtggcacgatgctcaaaaagatacgaaaaaagctgcttcctgcacttttggataaggtagaaaagcaacagccaatgaccttattggagaaagattttttagaagaatccagaatggagattgattcaggggaatagaaatcgtataatcgataatataaaacagagttattcaggttacaatatgaagtgaggaatagactgatatgggaaatataaaagcagaagaagcaatgagggaattaacactgatgctgttatacctctcccgctttacacagagagaaaagtttcacgaagcaaccgatttttatgcatggaaaggctacgattttgatatactgaacgaattggacgatgcagactatatccggcagggaaatcatccgtcccgttccaaatcggtatatattacggaaagcggtatggaacaggcaaaagagcttttatccaaatatggtatcagtgattggaaacaggggtgagaaaatgaagaacctttttgaacgcaccagttctaattgggtgcggtatagtgaatatgaatggaaggcggcagaggacggaactctgtatctcacgcccaccaaaacggcgcaaccgagtatttatgatccgctggcagagtatcagaaaattgtattggatgccatcaacataggacgcatgggtatgagcaaaaagccggatgccgaaattcagaaggctatccagcaatttgcggtgaaatacggcttgtttggactgatgactgcgttacctaccacaccaaactttatggaatatgaggcggtgtatctgccgaaaaaccactttatcaaaaaagaaactatgtccacggaaaaatatctggcactgttctttccatttgacaaattggatgtgatcaagcgtggtatcgagtccatgtggaacatccaaaatgaccgtgttatgatggcactggctttgaccatgacagataagccgatggcggtcaacatgagctttcagcgggaatatgcggagcgatatgaatggataaaacagcagttcatcgactgggcgtttacctatatcaacagtttcctttattatgaggattatgatacactgaacgatgaaacccggcagatgatgcagcagagcatggcggcatttggcggcatcgctccaacttatcatatagcccttttggataagccgacgattatttgggattttcactctctcatgcttggagttcagatgatgttcagctttatgctgaccgacagcgaaaacccgattaagctttgcaggcattgtaccaaagcttttgtcgcaagcagaccaagtgctgtattttgcagcccgcagtgcaagaacaagcataatgtttacaaaagcagagcgagaaacaaaagtgaagaataggaagggaatggaatggatatgaacgaagaatatgggctaactccttatgaaacaagggaaatcctgttttataaaactgataatggtgaagttcgggttgaaatccttttatatcaggaaaacttgtggctgacgcaggcaaagatggcagaattatttgaagtgcaaaaggcggctatttcaaaacatttgaaaaatatttttgcatccggcgaattgcaggaagaagcagttgtttccaaaatggaaacaactgcggcagacggcaagcggtacaatacaagctattacaatctggatgccattattgctgtcggataccgtgttaattctaaaaaggctacgatgttccgcatttgggcaaatcgagtattaaaagaatttattattaaaggctatgtgatggacgatgcacgactgagagaaccagaaaacctctttggtaaggactattttgaggaacagttggagcgtattcgtgatattcgctccagcgagcgccgtttttatcaaaaaatcacggacatttactcccagtgcagtgctgactatgatgtgaacagtcctgttacaaaagagttttttgccacagtacagaataagcttcattacgctgtcactcatcatacggcggctgagattgtttatggacgagccgatagcacgaaaccaaacatgggcttgacaacttggaaaaatgctccgcaggggcgtattcgcaagtctgatgtttcaatcgccaaaaactacttgaacgaagaagaaatgataaatctgaatgagatcgtgacaatgtatctggactatgccgaaagacaggcacggcgaggaaatatcatgtatatgcaggattgggttaatcgtttggatgcgttcctccagttcaacgaagaagatattttacatgacaaaggcaaggtgaccgctgccatcgcaaaggcgtttgcagaaagtgaatttgaaaaattccgtgttttgcaggacagaacatatcagagtgatttcgaccgtcttgtggcaaatatcgaagaaaacagcaaacaaacaaaataaatcaggaaaccccacgcttccgattttattgtcagaagtgtggggcttttgtatcaggtttacagatcatataccaattcgtgcagaacgatttcttccgcacggttacggatactgttcatacggcgcacccattctatttgatcagccgctttgaacgcttcagttacgccttcctgctttgccatagctgaaacgatgttttcaatgcgctcgttgcagacttgatcgatttcagctaaatgcttgaacagcgttccctccagcacatagttgttgtagagtattttacggtactttttcagatagctgcggcgcatacgcccgtatttgcctatctgatattcgccgtcatccggcaaagtaatgttgggaatgaaataatatcccacttgacggtatgtaccgcccatttcttcaaagatagttttcataaaattcagctccttttgtgttgatttccagcggttataaggctttttgactcctttcttacaactgcttttcaattcaccacaaatgagccgcagtcatatgtattaggtggcagaaacaaccctttacatattaactcttgatacaatggccttttgggtttgtttttgtgatttgattattagttaattgttattcgttgtccggagaacttccggtgctgatccatttcaggtaggcgttgatgaaggggtcgagggctccgtccattactgcgtctacgtttccggtttcatggttggttctgtggtcttttaccatggtgtagggttggaatacgtaggagcggatttggttgccccagccgatttctttgacttcgccgcggatgccggagagtttttgggcgttttcttcctgtctgagcatgtatagtttggccttgagcatctgcatggccttgtctttgttctggaattgggagcgttcattttggcattgtaccacaattcctgtaggaagatgggtgatgcggattgcggaggatgttttgttgatgtgctgtccgcctgcaccgctgcttcggtaggtatcgatacggagatcttcttcgttgatttcaatatcgaggtcttcttcaatatccggcataacatccagggatacgaaggaggtctggcgttttccctgtgcattgaagggggagatgcgcacgaggcggtgtactcctttttcggacttcagatagccgtaagcgttttcgccgtttacctggaaggtaacggatttgattccggcttcgtctccgtcgaggtaatcgaggacttccagggtaaatcccttgcgttccgcccatctggtatacatgcggtaaagcatgctgcaccagtcgcagctttctgttccgcctgcgcctgcgttgagtttgaggatagcgccgtttttatcgtattctcctgtaaggagggtgctgatacgcagcgtttccagttcgtccgtgaaggaatccagttctgagcgtatttcttctgccatggattcatcatcttcttcattgcccatttcaatgagtgtttctatatcctcatactgggtactgagatgttctatctgctctacagtatccttcagattctttaattctttcattttcttattggaatactccggattatcccaaaatcccggagcctccatttcacgttccagttcttcgatcctcttcaacttttctgctaagttaaagtgaatccctcacttccgccaatggagttttataagcctgtaattcctgtttcatctgatctaacaaaaccaaagtcgaacaccacctttactttttactatctacgagccgggcgcaggggaggaatcagaaagctttcgggaaacagacgcccgggccgccccatgcccggacgcctgcttcccgaaagctttctgattcctcccctgcatgcggcgacagccgcaaagcgaaagggccggaggcccttgagcctgcccggcgggttaccgggttacacaaaaagtcgcggacaccacaccctcccgggtttcacattccaaggaatgtcacttattccttccacaacaattcttatacttcttcccacttccgcaagggcagggatcattcggataaaccttagccgcgcccctcttcaccggagccttcgggcctgagtcatccttattggtgccggtcaccttagcgacctgctctctttccaccttctgctccactctcacatggaacagcagacgtatcgtatcctcacggataccgtcggtcatggcatcaaacatctcataaccgctcatcttatactcaaccagaggatccctctgggcataagcctgcaggccgattccctgacgcagctgatccatatcgtcaatatgggccatccacttgttatcgataaccttcagcaaaataacccgttccagttcacggatagcctcaggttccgggaattccgcttccttgctttcatacagcttcacagcttcttctttcagctgctgcttcaggttgtttctcttcgaaccgttcacacgtgacttcgtaacaggcaccaacggtattatcggcagaagaagggaattcaattccttgaaattccagtcctccacatccgcatcttccccgattaccatgtcgacggtattatccacaatatccgtgatcatcttgtagataacatcccgcatgctttctccatccaggacacggcgtctctccgcgtaaatgatctcacgctgctcattcataacctgatcatattccagcaggttctttctgataccgaagttgttgctttctatcttcttctgagccgtttcaatggcgttgctcagcatcttatgctcgatttcctgattttcaggaacacccatggtgttgaacatattgatcagacgttccgaaccgaacagtctcatcaaatcgtcttccaatgaaatatagaacttggactcaccgggatctccctgacgtccggaacggccgcgcagctgattgtcaatacgtctggattcgtgtctttccgtaccgatgatcttcaggccgcccgcttccttcgcggcatcatccagcttaatatccgtaccacggcccgccatgttcgtggcaatggttactgccccgtgcacaccggcatccgcaacgatttccgcttccagctcatggaacttcgcgttcaataccttatgagggattcccttccttttcagaagcccgctcagctcctcggaagcctcaatcgtaatcgtaccaaccagtaccggctgtccctttgcatgggatgcctccaccgcttccacgatcgcatgcagcttttctttcctcgtcttatacaccgcatcctgctggtcaagtctcagaatgggcttattcgtgggaatctcaataacatccattccatagatatcacggaattccttttcctcggtgagggcggtacctgtcatacctgattttttctcaaatttattaaagaagttctggaaggtaatggtcgcaagcgttttgctttcccgcttaacctgtacgtgctccttcgcctcaatcgcctggtgcagaccgtcggaataacggcgtcccggcatgatacgtccggtaaattcatctacgatcaggacctgatcatcctttaccacatagtccttgtcacgggccatcaggttgttggcacgcagggccaggatgatattgtgctggatctccaggttttccggatccgccaggttttcaatctggaaaaaccgttccaccttggcaacaccctgctctgtaaggtttaccaccttatccttctcgttgactacgaagtcgccgctttcttcctgttccacgcccatgatcgcgtccagcttggacagatcttccatatccgcgccgcgttccatctgtttggcaaggatatcacaggcctcataaagcctggtggatttcccgctctgtccggaaataatcaaaggcgttcttgcctcatcaatcaatacggagtcaacctcatcgatgatggcataatgcaggtcacgaagcacaagctgctccttataaatgaccatgttatctcttaagtaatcaaatcccagctcattattggtaacataggtaatatccttggcatattcagcccgcctctcctccggcttcagactgtttaaaaccacacctacttccaggcccaaaaactcatgcacagcgcccatccaggcggcatctctggcggccaggtaatcattgaccgttaccacgtggactcccttgccttccaaagcgttcagataagcaggaagcgtggacaccaatgtcttaccttcacctgttttcatttcagcgatacgtccctgatgcaggataataccgccgatcagctgcaccctgaagggctccatattcagtactctcctggcggcctcacgtaccgtggcatatgcctccggaagcagatcgtccagagtttccccatcggaaagacgcttcttatattccttcgtcttatccttcagctgttcgtcggaaagttccatcatggaaggccttaaagactcaatcttgtccactatgggagtgattcgctttaattccctttcactgtgcgtgccgaaaactttttgaattacattcattttgtatttgctccaatcgttttgtccgcataaaataacctgtcgcggcccgtttcccggccttttacagcctgagccggacatgcactaccccctataatagcagaaaagcggcgtttgttcaacttttatctgctatccgggaaaaccttagcctgtttttggcagctgttttcaggaatatctttacaaaagctgcctcttccgttttatttatcatttatgttatatgactttttctcaaaaaaatctatagataaactatgaaaagtctgtaaattttccctttggtatccaggccgcagacatatccgtccgctgaaactgctcagtcaaacttgtatcatataaaaatatgactcagcaaaaagactgtcggcagccccctgtgctcactgccgacagtcttcctgttctttacttgaaataccttccttttttttaaatcatctttttcctggtagattcccgctccagcacggaaggcagtgtgctgtaataacgcactgtcagattaggcttcctgattttagacaaaatacattttccggtctgataccccatgtcaaatacatcaatatccactaccgtaagcattggttttaaaatccgcgacagcggatattcatcaaaagcaattacccctatatcctccggaatcacctctccatgctctttcagcgccataacacagccataggcgatataattatttgcacagataatggcatccggacgctccttctgggaaagcagctcctccgtcatggcataaccgctgtcgcagtcagaggccccgcgtctcagatgccctcccgggatcagcacatcgtgctcatttaatacagaaagcaccccttccaggcggtgtccgctgatacggtcctcctgccttcctcccagaaaagcgagagagcaatagccgcactgcagaagataacgcgccgcaagctctccgcccaggcggttatcgatatctatccagctgaaatggctgggaaaatcagggatgccgatcacgatatggggaatttccctcgcggcaaccagttcatccatggctggtgaaataatggacgcatgcagaaccacgccgtccgcctccttggaatcaaatatcttttccacaaagccgcaggcctcttccgccgtaatgcttttcacacaaagcagatagccctttttagccagcgcctcttccatccctgacatcatttcaaacatatggggattgctgaagcccgcatttttacccaatgttgtcaaaaacagcaccatctttgtggactgccttgcaaaattgcgcgccctggcgttgggatggtatcccaaatcgcgcatggcctgctccacacggtcaatggtcgcctgtgaaatggaaccggaaccattcatcacctttgaaacggtagccgctgatgtctgcgcggcctttgccacatccctgattgttaccgacatactcttctcctcaccattccttttttatgaccgcaaagcctctgctgcccagccgctcaccccgcagcccgcactgccacagaatccggccttccagccattccggcataagcgccgcgtcgttttcttccatattcatggcaaccagcacagattcttccggaagccgcctttcatacacatacagcctgcttcccttttctgcgctcaccgtgcggaagctgccccggcgcaaggccttttccccgttccgaaggcggatggcctccctgtaaaatgacaggagcgtatcctcccgcccccagggcatagcctgtctgtactcatcctccagcacaccctccactcccagctcatccccataaaatatggaaggcatacccggaaatgtcatgagaaaaagcaccgccagttcataagcccccctgtccttgccgcacagagacaaaaaccggctcacatcatggctgtccagcagattcatctgggcgaaaacactctgcctcctgtagcgtatccgcatatgggtaaccctcccgtcaaaggccgccgcatctatggaacgggaggcaaaaaacctgcggcaatgcttgcggaaatcataattcatggaagaatcaaaaatctttccgtccagccagtgtcccgcgctctcccacacttcaccgatcagcgccgcttccggattcacgcccttcgccgtccggtaaaaccgccgccagaaatcgtcattcacttcactcgccacatccagccgccagccgtcaatatggaactcctccagccagtaccggcatacccggcagaaataatccgccaccgcttcccgatccgttgccagcttcggcatcatgcgttcatacccaaaacactcataatccggatagacctccggatcctccggcctgcacaccgggtattccagccggtaaaaccagtcacagtattgggaatccttccctttatccacaacatccccgaatttatcccactgccatccacaatgattgaacacgccgtctataataacacgcattccgtttccatggcacgtatccaccagttcgcggaaatcctcatcccggccgaagcacggatccacatgaaaataatcgatcaaatcatacttatgatattcccccgcggcaaaaatcggattcatatacagggtgttaaatcccagctccttcagataaccgatattttccgtaattccccgcagggttccgccccgtttccctcgtactgtttttccatggaattccttcctgctctcctcattgctgataaaccctttccctgaagcaaagctgtccggaaaaatattgtaaaccaccgcatcctgcatccattggggaggccggacaagatcatccctgtgcatatagggaaactgataatattccgaacggtcatccacacaatgatcggagaaaaaatccccataatacaaaaaccgctcttcccccgccgtcagctcgaaataataacataaccgcctgtaggggctcacaaactccgtttcataataatcgaacagctcatcctgagccgccaccttcatgaggacagaatcaaaaatcaccggcgtctgccgacaggaacgatccccgtaatacagccggcaggcatccatatctccccgcgccgtacgaagccggaagaccatacgttcctcatccagggcaaaagcatactgtgacataggaatatgcaaaactgcttttttgttcataccgtatcctttcagccttttactccgcctgaagtcaggccggttgtcatgtttttctgcaatgcgaagaatatgatcagaatagggacggaaaccactatggaggctgccgcaaacaccggccagctgccgctcatctccgtagcctgcagagaataaagccctgccgccagcgtataggtttcctctcccgtcataaagttaatggcaaaaatatattcattccacacataaataagcaccatcatccccgttaccacaatcgtgggcctcgccagaggcagcacaatcttcgtcaccagctgcaccggtttcgccccgtcaatcatggccgcttcttctatttccaacggaatcgtatcaaaataccctttcatattccacagggcaaataccgacatggttcccgtatacacaatgagaagccccaacctgctgttgataagccccatgggactcagcagcttatacagcgccgtcatggaaagcagcgccggaaatgcatacagcagaatcagaagccgcagaataactttccttcccggaaattttttcctggaaaacacataggctgccgggattcccgtccccagggaaatgaaaaccgcggccgccgccatccatatactgttggaaaaccatcttaaaataggttcctccacaaataccgcccggtaattcgccagcgtcatatgctttggaagaaaagaaaaatcggagctaagcagactgttgtcagcattcagtgacacggaaaatgcatacagcactggtatcagcaccagaaaacacagcaagacaaaaaagagattaaccacaagcagcagtgccgctttcctggcttttttcccggttttataagtcatttacccctcctccttcctcttccctccggtcacacaggaaaacagaatcagcataaggaatataagaatagacactgccgaactgtacccgtaattattagttataaatgcattttcataagcataggtaagaatggtatgaatatgcgcgcctgtcttccctcccgcctgctgtgtcagcaggtaaatcacatcgaactgcttgaaggtggtgaagaccgtaattatgacggacggcgcaataatgggcctgatcatgggaatcgtgatataccgcgccctgtccagccaattcgctccctccagcagggcgctctcataaaagcttctgtccacgctctgcagggcgccgtcaatgatagttatcataaacggcagcgccagccacagatttacaacggtacagcacacaaaggcaagcccgtcccccgacagccagcttaccggctccatccccaattttcctagccactgattcaaaagcccgaactgcgaattaaacatccccgtcttccagagcagaatggaaacatatccgggcatcgcccatggaaaaatcagcagtgttttataaatattgcgaagccgcagccctggaagattcaataagctggcaagaaggaacgctatcaccagctgcagcaccatattgacaactgtccataccaccgtcagaacaagcgcctgcagaaacccattatcaaataccagcaatgcatccctgtagttatccagcccaatcagctcataatcaaaccagtggtatacgttcatattggtaaaagaaatataacccgtatatacaatgggaaagattacgatcagcaaaatcagaagcagcgaaggcgccgaccacagatatgctgctattatttctctctttctctccttacgctccaccctttttctcctttcccgcttctcacttcatctgcccgatcagccgcagcgcttccttctgcgccttgacacagctttcttccactcccctgccgctcatattaatatcagccagcagatttcccgccaccgtccacataacatccatttccggccggttcggcatgggaaccgcattttccgccgtctgcttcatagccataaccacatcatccgacaggatttcctccatctcataacaggcctcactggccggcgcacagccgctggccttagccaaatccacctgaagctgcggatccatcagcttacgaagcaccagctccaccgcttcttttttattctcccctgcaattttaagcacctggatcccctgaacaccgctgtaaggcgcaatcggcattcccgtttcatccaccacaggcatgggtgcaatccccagatccattcccgactgccgtacagtaggcaccagccacggccccgctatcgtagcatgtgctttcccctcactgaaaagagtatttaccgtggcatattcgctttcccccggcataagctccacaaatttcttatgatactccagcgccttctgcgtctgaggcaaatccagccccggttccccctggtcattcatgatatagcccccgaaaccatgaatccaccccgcgctgtaataagccgtactatgctgctccacaaacccataatggccgccctttgtattctcctccatataaaaataaagctcctccgtagtctgcgggacctcttcctccttcatataccgcttattatacataaacaaaagcgtctcataataaaccggcagctgatataccacatcctgataggttgccgccttaatcgtcatatccatatacggttccagttcctccatgggaataaaatccgtaacaggagataaaatccccatctccgcataaacaccaatcttatcatgagcaaaaaaatacatatccggcgcagctttaggatcattccccaccattttcaaagcttccgtcaaatcgcttttccgctccagcttcaccgtcacctccggcgccagctcatccagctgcttctgcagtacctggacaaccgcatcctccttatcatgccatatcgtaataaccgattgatccgccgcttccttcccctcctggccgcagccccccaaagagaccgcagccaacataaaggcaagtgcagcgctgattattttcttcctcatacgcacctttccgcccctgaccgggcatccccttaccctttccttttcttacctgccaccaccgctgcagcaatcacagccgctgtcaccacggccaccagaataatcaccggcgccctgcttccgctctgttccacagacacccccgtttcctccgcaccaggttcctgcgtttcctccgccgtcatccgctcctctgtctcacccgccgtgccttccgccacaaccgccccttccggctcctcataaaaaacagaagcatcctctgcactgctcacgaccacccagacatccttacccgtatcaaccgaaagatccgccgtctgcacacttccctccgacccattaacaataactgaattcacccatcccggcacacttatcttcagccacccggagccatcctccgccaacgcttctcccggccacgccgcaaacgcattcgtcccatccggcgccgaccacgcccaaagacagggactctcccaatccgccggcgctttcacccacaccgtaacatccggaacctcctccgcatccggatcctcataactgaaatcaaaactcccatcctcaccgacactcacccagatatccgcaggatctatcgatatatcctccgtctgcaccgccccgtcatccgcattcacaataatagaattcacccagacaggaaccttcacctcataccatccgctctccttcagaaccaacgcctccccgggccatgcctcaaacacattcttcccatccggcgccgaccacgcccacaaacaaggatccttccagctttcatccaccttcacccgcaccacaaacttttccacatactccggaatatcccccttcgtctgcggatccgtaaaaagctccacattctctccatcctcaacaacaatccacgtattcctaccctccagcaccaactcccccgtctgcacatcaccctcatccgcattaacaatcacatgatccgcccacgaaggaatccacacataataccacccctcattccccctgtccgcatccatctcctcacccggccaggccgcaaaagcattattcccctcctcatcccaagcccaaatacaaggattctcccaatcctccggcacctgcacatacacagccacccgttcctccccattttctgccaagacactaaaaggcacccaaaacacacccaacaaaacacccaaaaccaacaatccccacttcttccaccgtttcaacataatccaacctcctctttctcttttccgcctgttccaaaacctcaacacaaacaactcccaaaaccaacttcttcctacccaatcccatattccgcatcccctgaaatatccgattgattatgctcaaattctaccatccccacccacccccagcaatcactatttaagtaaccgtttaccccattttttgtacatatccctcgaattaccaccccattttcatacaattatcccaatcttttccccctttccgccaatccctccaaatttttgtgaattattaacgaaactgtttccctatctccccttagtaaaaatctcctcttataacccctccctacctttctccctatcgtaaacctgtccttcaggataaacgcatcctccacaggggcctgccgccctgcctttttccctcctctccggacggctgtgtatgtgtttgctgagacatctgaaaaaatagtgatgtttcttaatgttccgttcagccggaagactgccgcccctagcggcttgtctgacgaacgcagtgaggagttttgccgcgttggcagccttccggctgaacggaacatttagaaacaccaccatttttgaagctgactcagcaaacacatacacagccgtccggagaggagggaaaaagacagggcaaccaggcccctgtggaggatgcgtttatccgtttctccgcccaatgcttgacctttataaatagaagtgttataattttaacaatgggctttaaagggaggactctgccctcccgcgcccccgaaacctattaaatatcacacaaattcaattctattaaatgaggtatggacaaatgagtacaagtttcgatggactgatttccaaagtaaaagaatgcggacagaagaccgtttccgttgctgttgcacaggacagcgccgttcttgaagcagtaagagccgccaaggaccgcggcatcgccaatgcaatcctggttggtgacgaagccaagattaaagcgattgccgaagaactcaagattgatgtttccgattttgaaatcatcaatgaaccggatgaatggaccgctgcacttaccgccgttaagcttgcccatgacggaaaagccgatatgtacatgaagggccttctggaaaccaaaaccttcttaaagagtattctcgacaaggaagtcggcctgcgcacaggacgcaccctgtcacatgtctgtgtatttgatatccccggaatcgaacagcttcttttctttaccgatgttgcattcatgacctatcctactctggaggataaggtacatattatcgaaaataccgttgaagtggctcatgcctgcggtattcccaaccccaaggtagctccccttgccgccgttgaggttgtgaatcccaagatgcctgttaccgttgatgcggcagaactgaccaaaatgaacgaagaaggaaaaatcaccggctgtatcgtagacggacctctttcccttgacctggctatcgatgaagaagccgcccgccataaaggggctacacaccgcaaaatccagggaaatgccgacgtcctgctcttccctgacatccatgcaggaaacctggtttacaaagccatcgtccatatggttgacggcgtaaagaacggctgtatcttaaccggtaccaaggtgcccgccatccttacaagccgttccgattcctttgagacaaaggtaaattccatcgctctggccgctgttgttgcggaagagctgaacaagacccgctgaaaaaacagtccggcagtgaaactatgcggcacagccgcttgtaatcagaaaaggagagcgaaaactatgtcttataagagcttaattatcaatcccggttccacctccactaaaattggtgtgtttgaggacgaaaaccttctttttgaagaaaccttaagacatcccacggaagaaatctccaaatatgcttccatcatcgatcagaaggacttccgtaaggaaattatcacagaccttctgaaggaaaaaaactttgatataaattcccttgattttgtcgtaggacgcggcggcctgttaaagcctatcccgggcggcacctataaagtgagcgacgaactgctccacgatctggaaatcggctatcagggacagcacgcttccaacctgggaggcatccttgcaagagaaatcggtgattccatcggtgttccttccttcatcgttgaccccgttgtcgttgacgagcttgaacctatcgccagatattccggctgtcctgatcttcccagaagaagtattttccatgcgctcaaccagaaggctgttgccagaagatacgcaaaggaatccggcatcccttatgaacagctgaacctgattgtggtacacatgggcggcggctgttccgtaggcgcacacagaggcggcaagatcgtggatgtcaacaacattcttgacggcgaaggcgctttctcaccggaacgcgccggaacagtacctgccggtgatctggttaaaatgtgtttctccggcaaatatacggaaaaagaagtttataagaagctggttggcggcggcggtttcaacggctatgtgggaacaaacgatgcccgtatcgtagaagataaagcgctggaaggcattccggaatacgtggcaatattggatgcattccattatcagatcgccaaggatatcggagctatggctaccgttctgaacggcaaggtcgacaaaatcattctcaccggcggaattgcttattccaaggttacccgtgatgatctgcaaaaacgtgtgggctggatcgctgattttgttgtttatcccggtgaagacgagctcctggctctggctcaggggggccttcgcgtaataaagggtgaggaagaagcaaaggcttattaatcagccgctgggaaggataacggataagatacatgacaaaaaaagaactggcaattgccaatcatgataaaaaatacaattgctgccaggctgtggcctgttccttctgtaaggaaatcggcgtggatgaggaaacactgtttaaggcaggagaagctttcgggctgggcatgggcggaatggaaggcacctgcggcgccgtatccggtgcggtaatgcttgccggctttaaaaacagtgacggacagctgaatgatcccaaaacaaaagcggaaacctacaagctttcccgcgagatcgtaagacgctttgaggaaaaaaacggctccctcatatgccgtgatttaaagggcattgataccggaaccgtgctccgcacttgtccgggctgcattgaagatgcggtggaaattgtccaggaagtccttggactgtaatccctgtttcatttcattttgataaacgcataaaaagcttgtccggagattgtcgatccgagcaggcttttttgctgtcggaaaagaatgcatccggctccgatgcctgtttttactgtatttattgttttactttcttttcttccttgaatttgtttcgattatattataagattttaagaccggcccgaaggcctgttgatcagactggcagaaagaaatacggccagtcctgaagattttcagacaatatcagaaatcttgtattctttgcataaacgttctcttagtgcagtgtcttcactgatctgtgataattcctccagacggttatcctgtaaaagagccttaaccaattcgaggattctttcttcactctcttttttctcgcctgctgcccattcctcaaatgtcataaactttgcctcccattcctgactatattataaacatttattcatgttttatcaacctgcatttacccgttttcctatttttttcctgccgcggcggtcaaaatcctgccggttccagcggaacaaaggcgccaggaattccacgagcggtttccaggaaaatacagctaccaaaagaacgctgaacaggagggctaccgcctcttcatgctctataaaactgaaaaactttatcttgcttaacagcttaatcacaaagccatgcagaagatagaccggcatggtattggctccgatataggaaagaaagggaatctttctcacgggcatacacagaaggaaaaaagcaagccacaaaagagccgcagcgatgctcagaagcctgaactgccagccataatttcccttttcataggaaacggatccgtaaaaccatgcggatttgatatcctccacattctgtccgatcagccagacaaaggcccccagtatgattcccaaaatgagaatggcagcgcctttaaaaagccatttttttcttttatccgcctgataatccggctgttccttctccttacgcagccccgatgccgtctcctgtgctttcctcttcatatccctgtaataaacgcctaacaggaagtaggggaagaactccacgatcctggatgcggacaggaaataaccggctttctcatcaaaaccgatgaatacactggcagcggccgccgcgagcagcatggccatttttttcttcatcccctccacctgcaccaggggcagcaccagattccatacgatgatggcaaaaagataccacagcagccagtaaggggtcgtatactgcatatccgcatccttgtccagaatttgatttgaaaaaagcagatacagtgtctggaaaatcagatagggatatatcatattattttttatcttagacgggttataccgcgcaaaaacgccggacacaaaagcaaaaaggggcatgtgaaaagaatagatcaccagataaatcactctttccggtgaatttttccccataaacaactccagcatatgcccgaaaaccacggaaaagatcaacaggcatttcagattatccatctggtaatttcttctgttcgtaccggctgcaagcatgtgggtatctcccactttctgttccatcataaacctccaggatgtcaatcaataactgctttacaaactatagcccttttcctttcggttgtccagattgaatattcttaaaaatatttaattatttcttagtatacagaacattattacaagaaaaacctttcccttttcccattattaagcagccgcgccggaaaggtgcccaatccagatggttacccggaaaatgccgtcctcatggcttatctgtatatggcctccgtaaagctccaccacatcccggaccgaacgaagtccatagccatgcccctccgctttttctttcgtggtcaccagccgcccttttgcctccttcacttctcctgcaaaggtattttccacctcaatgcagagcgcatcacccaccagccgggccttcagggacagtctccttttttccttctccggtattcctgaagccgcctccaacgcattgtccagaagattggcaaaaatagtgcacagactcacatcatccatatcgtagacttttttcagttccatgttaataaagcagggaatatccagcgtttccgccaggttatattttgcattgatcaccgcattcaccaggccgttctcacagaatttccggcttccggctgcagcggcaacctgcagcttcttaaaataatccagggctttttcatactctcctgtttccataaaggagccgataatccccagatggttattcatatcatgccgaagcttgcggatggcaagctgattacgttccagttcttcatagtaggactgccgcagcttcatattttcattttccagctcctgccgcacagcatccccgatatacaggcacagccagatacagcccaggctggcaacaatacaggcgatgcaggaaggataagctgtccatgcattttcaatcctggctgtggagattaccgtaatgctcccgataaaagccgccgtgcaaatcatatccgggagcagccatatcttagccgtcattaatcccgacatcctggacagccttttctggaatccgtaataaattcccgcccagaacagaacgcgcagcagaaagcttatccatgtcagaagcctgtccagaaaatatccgccgggcgtaaggcggaagtaaatcagccctgtcagatccgtagtgataaaattcacggaaaccatgatagggaataaaatcagcaccacggatattttttcaataatggttcccccataaaataaaaacaccgttgccgagtacaaaataagcatccccacaatattaatgggatcttccggaaataccaccatgtcaccggtaaaccagatgcctataaaagcggctatattccagaaaattccctgcttttttttcacaaaacaggcagtaaggcgaaaaatgtaatatatatagacagatattgttcctgccagaaacaaatattccagtattttatgtatcatctcagcataaacctcgcaaaagctgccgccgtttcctgggcgcaggaccggctcacggcaattttatccccgccgcagagcagggaggtattttccagcctcgtcacatagttcagattaacaaggtagcggttatggcaccgaatgaaggtatccggcagctccggttctatttccccaagctttccgtaaaaggttatattctccgttccggtaaccgccgtcacctttcttccttcgctgacgaagtaccgcgtttcccgcagaggcagcttatatgttcccgacttctgctccactatataatatttttctgccgccatatccagctcccggagggcctgatcaagaatctctcttatttttttatcctcatagggctttaatatataattcagggccttcacctcatacccatggaatacaaaatcgggataggctgttacaaatataataattgccgtacagccggactttctcagagctttggccgcttccattccattcatcccgcccatttctatgtccagaaaaataatatccgcaggccgttcctcatttcttcgcagaagttcttctccgctctccgcttcagtaatatggtattcaagcccgctcagctccagctgtgtcccggcaatatggcgcaggtcatttcttaatttcttttcatcatcacaaatcgttatctcaagcattattccgctcactccaactgcgcagtaatattatgtatgttatgattccgttgcatctgtggaacgtctgctgatcagttctgtgtcaaaaaagatatgctctacgccaatatcctgccgatacatccctttttccaccaattcataacacatggcgctcatctgctccattggaatattaatgacagatatagacgggataaaaaattccgaaagttcggaatctccatttcctatagccaggataccaatatcttcaggtattcgataaccattctttatgaacgaatacgccgttccccttgccaacgcatcagatgcacaaaagatacagtctacttctgttccctctttcatacgggcaatcagcgcttccccgcatgccgcgccaccatgagacgaattctctcctacaataaaatcattttctttaatctggattcccttatctctcatgcaattacaaaatgaaatatttctaagagacataccggggaaattatactctgccgttatcagaaaaggttttctgaaacctctttcatacaaatgatccgctgcaatttttcctattctggcgtcatctatatttgttgaactatatttttgagaatgtctgttatatataacaataggcataggaaaattcatagtctctaaaaattccatatcctctctggctgtatttgctataattgccgcatggaatttcttacggataaaagcttctttttctttatacagttccccactcttatatgggtaaattactatttgaaaatcttcccggcttttcagcttttgcgcttgcagaccggccaggaaacgggaagccatggttcttctgaaatcaaaactccagaaaagagcaaccacgaaatcggagctgctcccttcctttaaattttttgcggatatattagaacgaaactgcagcttttccactgcattccaaaccttctcctgtgtctgctgagaaatcttacgttcctccgcctttccatttattattatcgaaactgtactcagggatacccctgcctcttgcgcgacttccttaattcctaccttagccattcttctttcctcattttctattaatgaattttaaggatacaattattatacctaaaagaatacaagcacgcaaggatgacaactggaaacttattttcctgagactattggctccatgacttcaagcattgatgtagggtatttctatagcagatggataatcctctcccgtataaatcgtctgaactgctttttgcgtttccttctgcattgcccaattacccgggaaattactgtgaatggaatattgagggaaatcagaggatgaaatatccagccggagtttggagcctttttttaacatccaggaaatgtcccacatttccagatttatttccactatttctccaggggtatagtcccctctttccgttcttccattgcggtatgcaagagttgttattgttccacggatattgacagttgttccatcttcaaaaatttccatcagtttggctgagaaagcagtatcctgcacatctgagctcacataaagcttcactctgatttttccacctatttcaacaggatccacaatggttcctgaaataaaactgaccacatcctctctgtagccgcattccggctgaatcaggctgcctactcccgactgacttgaaaaaagagattcagcgccatgggatatcacaggattttgaggatcgtatatgaaacttacattactctgtcccggggcacactcttttgtaagtgtttttcctttgctgttttcctgttccgcatccagatatataatttttttgcccgcggcaggtacggaaaactgattccatttttcccatttatccgcccctatacaataggtatagactactttttcgggcatttccttctttatgagaagctgctcaaaccaatccaaaggtgactggacactatcatcccccagattctccaacggctgtccggttactgccgggctatatccatgattccaaggaccaatctgaaaaacactgtgttttcttgattcttcagacagatctgcataagttacaatggcgcttcccagatgatggtcataccagccctctctgataaatacaggtattttcatcttcccgggtatctctttcaattctttccataatccctgcgaccaataattgctggtccgatctgtattgctaatccaatctctgtaccattccagccgcacgccccacaatgcttcgtcaacctcaatctgaggacgatacatacaggattccagatgatccgcttcaataggaacgcctgcattatctcttgcccaggaagtaagaatatcctggcggaaaagcccatctttataggcggagacatggcggtcacaaccatacacacccaaatacatggtttttaccttgtccggcaccgcatccgccatacaccaaccggtaaacgccagataagaattcccccaataacccacacaatcggtaaaaggctgttcacaaagccagttaagagtatccaggccatcctggcgttcatttatattagggatccatttcccttcagatccattaatggaccgacaccactggattacaaaaataaaacctcttttacagaattctctcgcatgaacctccaggatatcttccatctgtgaatagcaggtacgctgaatcaccaccggacctgatgttattccctgtggaatatagcaaattgtcctcagcctgatcccgtccgacataggaagcataatttcctctatttttcccacatctgtaaacggtctttgtctgaccttttcatatagctttatagtataaagtcggtttttttcccttacattttccgtttccaagggctgtttttctttttccgcttcagtcatactggtacctcttatccgtataatattgcataatcatcaaacaatcagttctttttttagcttctccacttcatctaccggaatatccagatacttattcaaaatttttgccgtatcctctcccaaagttggggaaggcttatagatttccggcattgtgtccatcagtttgacaggattcccattcagtataatatctcccattaccggatgatgtgttttgacaatcatttcccttgctcccgcaatatgttcatcatggacaatatccttcaaatcgtagatggggccagctggaattccctttgcaagaaccatgtctacaatttcttcgactttttttgttttagtccattgttcaaaaatttctttcaacattaagttattttttacccgaagtggtactgtgagaaatctttcatcgtctataacctcaggacggttaataatctcacagcagaaccgctcaaacaatttttgattaccgcagccgattaccacatatccatctgccgcttcatatgtatcatagggtgcaatagcagcataggcgtttccattgcgttccggtatttctccggatacctcataccgctgtaccgcctgttccagactggcaaccacgcagtctgtcaacgccacatccactctctgccccttccctgttatcgttcgggcatgaagtgccgccagaatacctatggtcagattcagcccgcccaatatatctcccattgcacttcctgcccgggtaggcgggtctcctttctggccggtaatactcatcaatccccccatagcctgggcaatgatatcatatccgggtctgtccctgtaagggccatagcttccaaatccggataccgcaccataaatcagctggtcattaatttccttcagtacatcatagccaaggcctaaccgttccattacccccggacgaaaattctcgattaagacatccgcttttttaacaaggccttttataatttctttccctttttcacttttcatgttcagtgtaattccatatttgttacggttcaggttggaataatacagactttccccattaatatacggggcataagcacgggcatcatccccttttcccggcatttccaccttaattaccgttgctcccagatccgccagcatagccccgcaaaaggggcctgccaccactctggacagatccagaataactacgttttccagtgctctgtgctcggacataattacctccacgctgccggatggcagcttactgttaaaatcatttatcattctttttcatccacatctattttcatgcgcatgaaagcactgcccatagattttcccaggctgtcaagccttagcgaatgggttgcaccaccgcccaaagcatgtttcatcacaaagttaaatccgttcaaagacggtacctcataacgtgttatctcacccttcaccatatctccgaagtgttcttttacacgttctattgttacttctcttttaataatctcatagtattttggctctctggcaaaaatacagacattacttgtgtcccctttatctccggacctgccgtgagcaatctgattcagataaattctggccatgtttcctccattctgcgtttacttgcgcaactatttatttataagactactcaatttccactatatgagaagtgagtttaaccgcatctctgggaattagggtaggccaaaggccaatcacttcctgtacctttgccctgcctccgaaaaagcttgctcccggagggccgtttaactgaaggggggaaacctcaggaactattttcatggcttcatccttggttagcgtcctgatagcaattctcattaccacttcattcatatcctttatcttgtccggatccatttctgctacatttaaatgaagagcatttaatcctatataatcaatatggatttcctctgctttcagacccttgcgtttcatttttttcatcaggatatcagcggcatactgtgccttttcataagcatccggccatgcaaagctaagcattacggcaaccttatagcctgcatggtatcccatggaaagtttaagcatatccggtcttttctttcccttcacattacttacccttaccctgttttctcctgcctgggtcagggcagcgttactgatatccacgtttacatcaggggtcagatagtttgccggatcatgcacttcataaagaaactgctctttacaagactgctcacatataataccaccgcagtcaggcgctttggtaatgacaaaatcatctgcagatacttccgcaatagggaaacccaattcatccatcctaggaacactacgccagtcatactcataattgcctccggctccctgaccgccgcattccagaagatggcctgccataatacctctcgccagattattccagtcatcttccgcccagcccagttcatacatgataggcgataagaacaaggctgaatctgtggaacggcctgtaattaccatatcggccccctctttcagacaggatagagtaggttcatggccaaaatatacgtttgcattgaaaattttgtcttttacttcattgaaatcaccgatatcatccatgttatcgaaggtaaccccttctgccagcagccggggaatttcagcggagatctcatctcccaatacatagcctattttcattccatgcattccctgttcctgcccaagttttttcagttcgctcaccatgccttctatattcatgcctccagcattagtgagtactttgatatgtttatcaaaagcttcttttccgcagatacgcatcatctccagaaagtctcttgcatagccagccttaggatttttcaatttttgtcttgccataatggaaagagtcagttctgccagataatcgcaggcaagatagttaatattgctacgcctgaccatatgtattgctgcatcattgctgtccccccagaacccctgtcctccaccgataattactttatccataattttgctcctatccgcgcattatacgcatgcggctgaaaccctgttcggctaaagccgcataaaaatttaacattactgctttaatactttatagcatgcaactttgtgtcccggttctttctccgtaagttccggcatcttctccatacattcctccatagcataaggacatctgctggaaaaagcacagcctctcggccgttgcatggggctgggtacctcacccttaataatctgccgttctctggatgcttctatctccggatctgcaattggtacagcttccaaaagtgcctgggtataaggatgcataggattatcatatagggattcccagtcagccatttccaccaactgccccaaatacattaccgccacccggtcgctgatatgacgtactactgaaagatcatgggcaatgaaaagatatgtcagatccatcttttgctgtaattcttccaatagattgattacttgtgcctgaatagaaacatctaacgctgaaattgcctcatcgcaaactataaaactgggattggcggcaagagccctggcaataacaagcctctgtctctgacctcctgagaattcatgcggtaccctttccctgtaagccggatccaaacctaccaaccggaacagttccaataccctgtcctccatctcttgtttgctcatacccaaatcgaaattcaacataggttcttttacaatatctcctgcacgctgtctgggatcaagtgaaccatatggatcctggaaaatcatctgcatgtttcttcggatgggacgcatcttcacatcatccaatcctgtgatatcatgtccgttaaaaattatctgtccctcggtgatatcattcaatctgagaatagttctggctatcgtagatttcccacagccggattctccaacaagaccaaaggtttctcctttttttatttcaaaggagactccatccacagccttcacatccgcaatttttttcttcatccagccgccgaggacaggaaaatacaccttcaaatcatttactgtaagaatagtttcattatttcgttccttcttttttacttcagtggcccgctctttatttccaaaggttttcgttaccggagaacttctttccaccttccggtgacacgctgcacaatgtccggattctccttccacctccgtcagctttggtgttccctcctttgcacatatctctgtcatataaggacaacgattcataaaagcacattgatcttttcgattaaccagattagttacaaatccttcaataggaataagcttcctgtccttcggatcatgcagacttggcacagcctgaagaagtcctattgtatagggatgtctgggattcctgaaaatttccacggtctttccatgttctacaatttcaccggcatacataacatatactctatccgcatatctggctactatgctcagattatgggttacgattaccagagctgttcctgtatttttcacaatacctttcattaattccagaatctgagcctgtgtggttacatccagagccgttgtagcttcatcagcaatcagcagttttggatcacaggacaaagccattgatatcatgattctctgcctcattcctcctgaaaactggtgaggataagaattcagcctgctttccggatccggaattcccacctgcttcagaagctgtacaaccctgttttcagcttctttcttatccaaccccatatgaagcataatggattcccgaagttgttttccgatagtcatgaccggattaagagatgtcataggttcctggaaaaccactcctatttttccaccccgtacctttctcatctcttcactattagatttataacttagcagatcctttccttcaaaaaggatttcccctcctgcaatttcacccggcggacagggaattaactgcagaccggaatactgtgttacactttttccgcttccgctctctcctacaaaggctacaatttctcccggatccagataataggaaacaccatttaccgctttcaggattcctttttcctgtttgaattgggtttttaaatttctgacttctattaaatgttcagacatattccatttcctcctttagcgggaaccgcgaagcttgggatccagagcatctcttaacgcatcaccgcaaatgttgaaggaccataccgtgaccataagaaaaattccgggtattatagcaatattaggattggagttcagacatttataaccatcgcttaccatagccccccaagatgcagtagggggattaattcccatacctagataacttaaaccagcttctatcataatggcattccccaggttcatagtcatcaaaatcaggttgggagaaatacaattaggcagtatatgtttcaccgcatttttaaatcttgtagcacctccaattttaccagccgtcacaaaatccaattctttcagactgagtacctgtcctcttgtaagcctggcataaccgggaatcataacaataccaatacaaagcattatatttcccaggcctttacccagtaccccacccaaaaacatagccagtataataataggaatcgacatcatcgcatccattatcctcatgataacggaatctgtccattttccaagataacctgaaataatccccagcataataccgcagcttcccgccaatgcagtagaaacaagacccaccgagagagaggctctgcttccataaatgattctcgatagcaaatcacgtcccagtgcatcggttccaaataaatgccctccgccgggtgctttcagtgcattcagtaaatcttgttcgtaaggatcataaggagcaatcaatggtgcaaatacagcgcagattaccataactacaataattgcaaatccaacccataccggtttcctggaaaaaaactctttcagaaactgttctcttctttcggtagcggcactctttacttttttatttccaatgtcttttaccatcacatatttcctcctactcaattcggattctaggatctatatatccgtaaagaatgtccaccagcaagttgcataacattacaaacaacgcaataacaaacacaacattctggactaccatataatctttattgataatagctgtcatcatcagcgcgcccattcccggaataacaaacagattttcaataatcaccgtacctcccaccagtcctccgattgacattcccagcagcgtaactatgggaatcatggcatttttaagagcatgtccataaataaccgtcttttccttcaaccccttggatctcgctgttctgatgtaatcctgcgaaataacttccagcattgcggaacgggtttgtctggtcttcgatgctatttgtccaagggaaagaacaattactggcattaccaattttttaagtcccagagtaaagtcttctgtaagaggtgtatatccctgaacaggcaatattttcagcttaaggctcaatatcagtaccagcagcattccgacccaaaaagaaggtgttgctatacccaagttagcaaatacagatataatggagtccagttttctacccctgtgcgttgccgacaagatccccaatgcgatacctatcacagtagaaagaagaaaggctggaatcgttacagaaagagtagctgccaatctcttgggaatcagttttgaaacttccatagaatatagcacgctcctgcccatttctcctttaaaaaggcctccaacccatctcaagtactgtatgtaaagcggcttatcaaagccaaactgctgtgtataatattcaatttgttcttctgttgcagtttctcccagataaatcttaatcggatctcccggcataagatgcattactgcaaaaacaagaaccgtgacaataaacaggactattagcgattgtcctaatcgctttataacatatttgcccattggctcctcctgaatactttctatacctctataccctatttcggagacaggacaggatttaaacctgtcccgcccattttccttcctgcaataactcaataattatttgtctaaccaacatgttgcaggcgtccatgtagctgcatgattttttgcaaaattatccccctgtacatatggatacttaaggcctgcaatcaatgtaatataaagaggtttcccaaataaagcgtattcatcatatatttttttctgtagttccagttccttggcaactttggtatcctcatcaggtgcgatccgaatgtcattcaacaactgaatgcaatcctccggatgctggattcccgatgcataataggaacccgccacatccagatggcgtcccataaacaatcccaggtcaggccccacagatgcataatggaacatgattccatcccatcccccggtcataagttcaccattcttagcgccgtctatcaactccaccttggcgcggattcccactgcattcagattatcacaaattgcagttgcccagttactcgagcccgcaggagaccagaatgtagtgtcaaaaccatctccataaccggcttcagccagaagttcttttgctttttcaggattatagggatacccggcaacctctttattataggtaacagcattaggagccgcccactggttggtaacagtataatatccataccccagcgctgctgtgatcgtatcaacatcaaccgcatagcagaatgcctgtctcacttttacatcagcgaacggattgccttcctgggcgctgcttggtattattcccgtcatttccactcccacaccatttgaatttgtttccaaaacatactcacctgtaggatcaagatttttgatcgtatctataggggtataggaaatcatatctgcttcaccggataccaaagtattttcaattgtagccgcatccgagatgattgtaaaatcaattccgtcaagatatggctgtcccgccacacggtacaatggatttttttcatattttatactgacaccctgctcaaaggatttcaaaacaaaggggcctgttcctgacgagttaatccttgcccattccacaccgttgttctccacggcagtaggggacatataatatatgaaaaatcctatggattccagagaagcggaattccattccttaagcttaataaccacagttttttcatccgggcattcaatactgtctacattggctgcctcggttcttcctgccgcctggtattgctcgatattccatttcacagcttccgcattaaaatcggtatcatcagaaaatttcacgccttcatacagtttaaaggtaagtgtcagttcctctgcatcggattcccagctttcagcaagacagggagccaattttccgtcttcgtcataaaacaaaagtgaatcatacgctgtcctcaaaaattggatatgggaattagttgtgatttccggcgtataacctacaatagaaggggtttgtcctgttacaattttcagcgtaccgccagtcttgatttcccctgtattttcttttgcttcaacagatacctcttccgtcccagcggaagtttcttccggcatacctgtaccggaggcatcacttcccggtgaagcagccccgcttccagcgccacatccagcgattaacgatgccgccacagttacagccaataacgtactaagtaactttttcttcataaaattcttccttcctctttcgtttgcattgtacttgtttcaaacacaattatctgcatcttgacacatccttcaccaataaattactttgcatgccactttgtagatgatttgtctgtttaaaacgttattctaaaacattatattatatattttaagtacaacgttttactatggttgtattatatatgcttattgtcctatatgtcaatcctcaagtacaacgttgtatcaacttttctgttttcaacaaaaaaacctgattttccaaacgaaaaaaacaggttttttgtgcatctttttattttctatagttttatcatacatttctacgttccatagaaatcactttatccgtccaatctctgtaaaaccgttcctcatgggataccagaatcacggttccttcatatttgaccagcgcttctttgagggcttccttcgccagctcgtccagatggttcgtaggctcatccagaatgaggacattggagggcatcaatgtcagacggcacagctttactttcgcctgctctcctccgcttaaggtagaaagctgacgttctgctttttccctgtcaattccgcagcctgccagatgctgtctggcttccttctgtgtcaggtgcggaaaccagtccagcaaagccgacagtggtgtcatattcttcccgtcccattcggattcctgttcataataacctatgcaggcagtgtccgccagggtaaaaccaccctttaagggggacagttcacctaccagggttttcagcagagtggatttaccgattccattaaagcctgtgatcgcaattttctgccctctgcgtacctcaaagctgatatcgcttatgaccggataatagtaccctgccgacaaacgggatacccgcagggcggtttcaccgtgaggttctcctgccagagggaaggtaaaaaagggcttaatcagtgttttagccggcggttccagacgctccagcctttccagctgttttcggcggcccttggccattttactgttgacaccggcaatgttcttccgtatatactcctcggttttctttatttccctttgctgcgccgcataccttcggatgtattcctccctgaggtgttttttctgcttcaggaaatccgaatatttcccggtatatttatgaatcgtgcgttcctcaatatcacagatgcaggtgcagaccttttccaggaaattatagtcgtgggagactaccataaaggctttgggaaaagcggacagataatcggagagccattgaatgtgttccttatccaggaaattggtaggttcatccaaaagcaaaacatccggttcctctaacagcagcttagccagtatcaccttggcccgctggcctccgctcagtttccccagttccttttcaatgccgatggctataaggcccaagccttcgcaaatccgctgaatccgataatcaatggaataaaagtcggccgcttccagcatacgctgataccgttccgccattttccatacttcttctgcgctgctgccggaaatcccggaattcccggataccgcacagtcttcataggcttccagcatctttttttcaagctcatagagatttgcaaaaggggaatgcagatattccagaatggtctgtcctccttccgtcctcgcctgctgatccagatatcctatatggattcccggctgccacaccaggaagccctcgtcgggtaccagaatgcctgcgcataaatgtatcagggtacttttccccacgccgttggctcccacaacgcccatatgctctcctttaaaaagagaaacttctgcatttctatacagtaatttgtccccgaagctgagagacagttcttttatatcaagtaaactcatttccttttcctcacttttccaacgataaatatataaaacccacgatcctttttttcgcattttcgttcctttgctgatttctgcatcacaacaaaaaagcagaagatcgcaatgttacattcgaccttctgctttcccgtttaccgcaatatccgccgcagaaataaatctgccgctttccggcaatacaaaaggccgcagacaaaacattgtccgcggccgcattcacagtaaaatcacccatgttaaaaactggtatacaaaacaaacatccctcctgccgttatttatactaacggcatctgacatgtcccttctttccctgttttaacgatgaattcttttacctgtaattaacctctgtacaatgtctcatccatttcaattgtacagagttgattcgccttgttaactgatcagttattgccggaagtttcattttcctgtccctgatacctttccttgaatatggtttatgctatcataacagcaaattcttgtcaaccattccctttttcactgatatcttcactgatacccgccatatatccttcgatctgcagatattccgactgaatcctgtgatacatatccaagatcggctggcagcggtttctggttatttccatgatttcatcaaaatccaacgtcaccttgtcaacgacgtctttatctatcagtccatcctctttcatttttttaataatggagagaatacgctctttgggaaatgcatccttatagcttctggttcctgccagcgcgctgacaatatcagccaccgcgacgatccgttcccccatggtaaggtctttgccggaaatacccccgggataaccggaaccatccattttctcatggtggcgaagggcaatccttttaattttttcttccacatcctgtcccagtattttttctgtgagctccacgtgggtacgcatgacacgcatggcctggggacttaatttccccgggaattccagaatttccaccggtattccaattttgcccagatcatgaagcagcgcaccgaaatatacgtcactcagctgctggcctgtgatacccaatctttttgccagctcgtagctgatactggtggtggtcatcgtatgtgttacggtatggcggctgcggaaatcgatggtgtatatgaccatattcagatactttttgatttcttcctgcgtaaagggaaagctccataagcgttcccaaaattcctcttccccttccgcctgtacagggatcgtttctgcaaacgtatcctgcatgagcatctccgctatccaggggcagtatttctttcctccgtctgctttcaacagctgaacaaattccggaaagctatttctttctttttccataaaaatatcggccctgtccgcaatattcagaagctgggccactattttgttttcttccgatacctcgttcaggtttttcagaatgcaccagggagtatgatgaaaaagaaccgcaggggcaagtcttgtcaaaggagtaaaatacttgatgaacaggtagccataggctgaatggttctgcacattgctggtttcaaactccagcatacggctgatctcatccgttttataggcaccgatatcatgaaacatggcgatgacggaaatatccctggcagtcgcggtatcatagcttcccatctgttccagaagccgggaaactatgcaggccacgcggaagccatgatccaccagccgggagtccacataattgcaggtgcgccggatgatgcctatcatgcccttattatcaatataattggtgtattctatcatcttatttttcccttcgcctcttccttccgggcaaaaatttcacggaaggattcctcgaagggcgccgttgcgatcccgtattccgtaacaataccggcaatcagattatgatccgtcacgtcaaaagcagggttgaataccttcaccccttccggcgccatacgttctttataccacatttccgtaatttcctctgcaggacgttcttcgatatggatttccgcaccggtggccgtattcatatctatcgtcgacgtgggcgcacagatataaacaggaatatgataataatcagccgcaatggctacactggaggtaccgattttgttggcggtatccccgtttgcagctaccctgtcgcagcctacaaagacagcgtttacccagccgtttttcatgaccatggcggccatgttgtcgcagatcagggtgacgtccacgccggaggaaagcaactcataggcggtaagccttgctccctgcagcagagggcgtgtttcgtccgcaaacacatggaaatgatagccgcgttcttctcccagatatatcggggctgttgcggttccatatttgctggtagccagctgtcccgcattgcagtgggtgaggattccgtcccccggctttaccaggctgaggccatattcaccgatggccctgcagacccggatatcttcttcttttatggcaatggcttcttcccttaaaagcgctttaatttcttctaccggcttgtctttgctgtcggtcactttcttttccatccggttcagggcccaggaaaggttcactgccgtagggcgggacgaatccagatactccttctgctttttgaattcactgtaaaaggcttcataatcggcagcctgaatctgctttgccagaagatagatcccaaaagccgccgccacaccgatggcaggggcccctcttacctgaaggagataaatagcgtcccacatctcctgagccgttttcagccgtatgatctctgtcttgccgggaagctttgtctgatcgataatgacaagggcattctcctggtcgtccagctccactgtttcataatccattatatttttattttccattattttccccttcctgattttccgtcttttattttttcttccgcttatccttcagcctgtccttaagtgttccaacggtaattcctttcgcttccagttcctgcaggacggctgtcgctgcaaagataaggaagaaaatacccacaataagaaaatccagctttttggacattttcttttcccagttttttatttttgcatctgctgtcagttcttttttagccatacggaaacctccttcccgctttcttataccggatacggcacattttactccgtcaccacatcttcaaaccgggcctccgccgcttttgccagatcggcgggcgcaagctcaatctgggagccgattcggccgccgcttactatgacagagggcagggcttccgcctttttctcaatcactgtccggtactgttttttcatgcctatcgctgtacagcctccccggatatagccggtaactccattgatatccttcacatgcagcatcgccagggatttctgccccacggccctggcggcttttttcaaatccagttcatccgcaacagggattacgaacacaaaatattcttttgcaggcccctgtgtcaccagtgtcttatataccttttcatggggaagccccagcatatccgccacctgaagtccgtccacgaattcctcacattcataagtatagtgagaatacgggattttcatacgctccagtatgcgcatggcattcgttttgatttctttgtttttggccattttcgtttcctcttttttcagtacgtacttcatacgaagctattataacatatcaaacgcaaaacggaaatctgtcatttccccacagatttccggtttgatattttttatccggaagcaggcaccgggatgaaccggccttccgaatatatttattggatattcctaatttcgataacaaacacttcctcagatcgccctggcaacatcatacgcctgccatatggcattcatcagattccccaccctggcggcatccccaatgatatgtatgtttttgccatctttctcagccagcccggaaccgggtatatatccgatagaggtaactacgctgtcggcgggaagcgtctttttcccttccggcccttcaatctccactcccgcatcggtaatggctgtggttttcgtctgtgtataaacagggatccggtagaaacgaagaatctcccggagcatattgctgttggccgcacagagatttggcacattcagaatatcatccatgagttccacaataacgggctttttccccttcatcaccgcatcataagcgatttcacagccggtgaggccgcccccgacgatcacaacattttctccggtttctttatagcctcttaaatattccaccgcattcatgacattttccctgtccgcaccgtccgcgcggaggctgcggcattttgcgcctgtggctatgatgatttcgtccgcatccagggatgaaagattctccgggcttatctcactgtccagccgaacgtcaaccttcagcttttccagctgcctgatataccaggcgatcagcattttatccttttccttaaaggaaggggctgccgccgcgataaatacaccgcccagttccccgcttttttcatacagggtaaccgaatgaccgcgcagcgcagccacgcgggccgcctccataccgccgattccgcctccgattacagccaccttctttttcacggctgccggggtcagggccttcttcttctcttccagagtcgccgggttcaaggcacaatgaccgtttcccaccgggttcgtgccggtcgttccgtccggccccttgctgatggcgaagcagccgttatgacaggcgatgcagggacggatatcctctatctcccctgcctgtaccttcgcacagtattccccgtccgcaagaagctggcggcctatggtcaccgcatcgattctgccgcttcggatcgcctccgaagaggtatccggatcttccattcttccggcacagaaaacagggatattcacatgttgcttaatgaaagccgcatcctccagattacaggccagaggcatatacatcggcggatgtgcccagaaccaggaatcgtagcttccgttatccgcgtccagggcatccgcaccggcttcttccagaagccttgcgagggaaatgctctcctgtctgtcgcggccgaattccttataatcctctccgggaagcgcgccctggttaaagcctctcattttactggtgacgctgtagcggacaatgaccggataatcctttccgcaggccttcttgatctcccggatgatttccgttgtaaagcgtcccctgttctccaggcttccgccatattcatccgtacgcttgttggtgccggcaatggtaaactgatccagcagatagccttcgtgaaccgcatggatttcaataccgtcgatgccggcccttttacacagcgccgcagccttggcaaagccctggataatatcctgtatttcttcttccgtcatggcccgctgaagtacattaggatcccatacattaggcatattatcactggccgccaccagaagcttgtccgtccctatcattttcccgaggactttgttgttcattacctttttcagttctttgggcattaccagaacccgcccgaagcctgcgccgatctgaagaaaaaatttggatccgtagccatggatttcctccatcagatcatggatcggccccataaacatcttttcactctgatacagccacttgtttcccatcaggcttttcacacaggtgatacccggtataatcagccctacgccgttctttgcccgttccaccagatattccctgctgccctcattgaatttaaagccggcataccagttgatcggtgtcgtcccttccataggcgcatggacaaacctgttttttacggttactccgcctacccggacaggtgtaaataaaatttcatgcttttgcttcatattgcttccccgccttccctccacgtttttttcatgctatcattgtatcagatacctgattccattactcgtaccttggtaacaaatccgcacaaatgtaagataaaaggttactgcacgcaccataaagtaacgacaaagggagagcgaatatgtctgcagataattctgttcatgatcatctgaccaacgaagaatataatatggcaagtgaagtgtggtatcatgcggagctggttctgaagcaatgcgtggaggccggtgacgacgcaggagccctggatgccctggatacgctgaaggaagccgtataccggagatttcagcccattctcacccacagggagcttgccagtacactgctggggattctgggcgggatcctgcattttgcctgcagggacgccgggcttcccccggcttatctgaccttgatgatcttatggcagaaggaaaccttcacggctgtccgtacgcaggaggaatggctcaggagcctgaaagactgcatccgctatgcctgcgaactggtccgcagcttttccctgccctcctgcggccctctcatccgccggtgtatcgccctgatacagcaggggctgacggaggagctgcacgcggaagccctggccggggagctgggtgtcacgcgtccctatttatcctctcagtttaaaaaggaaaccggaaaaacattgacggaatacatcaatgcagaacggattaagctcgccaggcattatctccgccaggggcgcctttccgttacccaggttgccctgctgtgcggttattcggatcccaattatttcggacgcattttccgacgtctggaagggctgccgccgcgagcctttgcagagcaataccgcttgccggtgtaatgtacctctttacgtatttacccctgtagtgacacccggcactcctgactttccctgcccccgaacctgctttcagccatcccagcgttcttccatcaaagcaaatagctcatcatccgtcagatgattctccatgttcatgatcagcatcaccctccggtcttcctccgcataaagcaaatctctctgccattgataaaaatgtggcccgtcccctgcattgcgcaggtcactcatcaggcccttcagcacccatgcagtctgcttcatatccgtcaggcattcattggcatagaaaccttgccatttcccatgctccctttcccgcatggcggcatccgcaagcctgtaacatttttcagcctttcccgccaggtaaaaggcattcttccagtcctcttccatcgcgcacagaaggccttccgccgccaggtacgcaccggtaaaacagaagcggtgcagctttgcctgcagcagcacggtatcctcaaaaaggattttgctcctgccggacattcgcgcccccacaagcccgcattcctgcagatagctttcatagctcccctttgcccacaggcacaggccccggtaccactccgtctgtccccggagtgtttccgcttctgtcgcccacagcagttcttcttccctgtgcgcaggatccctcctgtattgggaaaccagcatacggatcacatgattggcaaactgctcccctgcacggtcatcctcatgcgggccgtatttcagggaatgccctgcgtaatgctccaggcatcccgccacctccgccgcattctcttttccgaaataggttccggcaaagcgttccctgtgctctgcaggattcacggcgccgtcccgccaaatctgtgcaatcaggtcaagcatggaaacatggggcttcacattggagcagttgattataaaataatccttcaccccatgcgccagaacctctttcagctcgctgcatacaaattcttccggacacggcagcatcgtcatatggttggccgcctgcagatcataaaaggacacatgataatagatcccgtgcctgccatgctcctcctctcccgggagtgcacacactctcgggttatgatttccctgccttctggataccattttcccgtagccgttatccgcccagattttaatcacatcctccggaagcttcaggcagccctcccggtacagctccatcgtttccccgtacaggttggtgcagcacaccgcctcctgatccgcttcctttaccagcctgtactgctcttctatcagttctcccatcagggccccgcgtttttcatcggtgtcatattccgggtcattcgcccagaacgggctgtccccctgtccgcggaagcccagattccatacggtcttttcccctttctgcgtttctatccctctccgccacagctccctgaacttttccggatgctcggcaaaggaagggttcagctccggatagacgcgggcgaacatgggcgcgccgagaggctccgcgtgatggtgtgtcacccagagtcccatatccgccgccagcctcctgtaattgtggctgttggcatccgttcccggaatcaccatgtttccgcccagacgcagcagagcctccatggccatctcaaatccttcattttccgtgatcacgttttccctgtcaaaccggcttttcttccaggtatgcagaagcacctcatcattgataaaccagccccggtatttcactgcataagagggggacaggtacatcccttccggaatttcggcctgcttccttttaacgaaattctgatcaagccagtaccagaatggcttcaccccgagaaatttctcactcagaaaaagcagggcatagataatacccagttcatccccgccttccagcagcatttccttttttccagccgtaatccggtacttctcctcccccagggaatgggttatccgaagaagaagcgtttcctcctgttttgctccttccggcgattcctgcagagtcattgccagatctctttgaaaccttttccatgcgcgcagcagcacggagcttttttccgtaccccactttatcttcatagcggatgttattttcatcgctttactgcttcctttcctctcttattttcctttgtaatcccatgcggatgcagcggcctgatcattcctgaaatcccgtcaccagaactatccggccgctctgcatcccctccgcatccgccgtaatacacgcccgtccggtttctcctgtcagccgtaccatcacactggcacacccgtgatacatatggatgctttcttccccatagggttcgttccccatcaggtttccgttatccaccgccatgatttccgcagggccttccgcacggaaacggacggacgcgctttcccggaaatacggattcccgtcctcatcctgtgcgcgtaccgtcagcagaatctcataaccgttctccggcggcaggaaaagctgctcctgatcaaaggccagcttcaccgcgggccccggagtcgttatctgataacggcattcctcttttcctccgttaaggccgatcaccgtgaccgttcccggctgccagggcaagaagccggaaatcagccggttggcgcatgcggacggcttcggcacatagatccgcttttcattcagataaagccgtacctcctcacagttggaagctatcacgtacggtatcaccgtcttatggaactggggaaaatgccagtggtcagccaaaagcggcatatcccaatgctcctttacgttctcatccgacagggaatagtccataacggaaaaatgaaccatgggtttcttactccaatagctctgcagaatatagtaacccggctttttctccccgtttgtgcggatcggcgcgccgctccatcccttggagggatagcccatggattcccccaggtagtcaatcccggtccagatcatccctccgatcacataaggaagcttctccggtacaagggaaggattttcatccgtaaaattctgcatctgatccggatgaccctggaaatactggtaaacctccgtccccaggatcagcttatccggtatcctttcgtgtatcataggataccactgttcctggtagttgcaggaaatcacatccacatatccggcgattgcggcaatccgttccatcctctcggcattatcatatatttccgtatcactgacttcatccacgaactgctggatatctttgattttggaaacatccgcaccgctctccctcttaaaatggggattcatggcataggtgacgggacgggaagcatccagccctttcacatgggccgtcagcatttccagggtgtccagcatccctttctgcccctggttttccacttcattccccactccccagataaaaatgcagggccggtttctgtcccgcttcaccatggcttccgcatccttctgccattccgtctcaaaataccggccatacaggcccccatgccatttatcaaagcattcctcatacacgtaaaagccaagctcatcgcacagatccaaaaattccggacaaaaggtgtggtgcgcagcccttatggcattgcatcccatctcctttaaggaaagcaggcgctgccggaagatttccttacgcaccgcagtcccgagacagcccgcatcctgatgcaggcacacgcccttaagaaggacatgctccccgtttacgaacatgccctttcccggcgccatggaaatctcccggatgccgacacggaaggaaatccggtccgcttcccgttccccgtccatcagggaaagggtcagctcgtacaggttcggttcctccgccgaccaaagctttgcctccggcaccaggatttccattcttccatcgtctgtctgtgcctgccattcctgctccccgtcacgcagtcctgtacgcaccgtcctgccgggaagccctgtatagacaataacccttccgttttttccttccacgccggtatgtatgataacctctttttcatccagatggagctcttccgtctcgatccacctgaccgttctgtaaataccggctccgctgtaccaacggtcggaaggcgttcccgtattatccacccggacctcaatccggttctccccttcccggacaagctccgtgacatccaggcggaaggagctgtagccgtatttatggcctcccgcttcttttccgttcacccataccgtactgttttcatagattccgccgaaatccagaaagcagcggatgccttccctcttctcctccagcgtcagcgtctttcggtaccagccgatgccgtaccggttccggtagccctgggacgccccttcctccatggatttatcgaagggcctgttaatcgcccagtcatggggcagcctcaccggctgaaaatttttgctgtttccatcgttccatgcgaattcccagccgtccatgatctccctgtcaattctcggtgccgttaaatctttcaccttcgctttgcctcccttttatcacatatgctcttcccggtattgtcccggtgtctttcccgtgtatttcttaaaccgcctggtgaacacatgatcgtcctcatatcctaccgacaggctgatttcccgtatcagcatattcgtggtaaccaaaagctcccttgcctgttccatcctgagatttgccagataatccgacggacggattcccatcttattcttaaattccactgccagtgtgaccgaactgatatgaagataatccgccagcgcgctcatggtcagctccgtcctggagaagttctcctccatataatgaaccgcctcttccaccagcctggaacgatccacattttcttctggtctgcttttcataatcatactgcaggcttcgcataaaaaatcattaaagtcctgaatcgtcagacactgggacagcgtaaatacattataaatactctccagtcccgcgctttccgccttccactccgaaatcagcacatggataatgtcattatacaaaagacggaacatcggcagcgaagggctctttttggtcatccgcatacagatatcctccaccgcccgttccacgcccgccttgtcacggctccgcagcgcctgccgcagcttctgcagataggaatccggcagcacattcaccgtatccccaaaggccacatcctcaaaacggatgattttattgttatcctgaaggaaacggttgtcaaaagccgtgtccgcctccagatatgctgcggagccttcggtaagatccttatgataattgctcaccgacatcacgaactcttcataacagtccttcccgatggaaaaaagcatgcccagcgtctcttcgatccgatccctggattcggagaacaggacaaacaggctctggctgctgctgaccaaatgtatgccatagccgtccagatgggccgcctgtgcgattacctccagcatcttggtatgtgccttattttcattgctgtcgctgcgctctcccagcagaaccgtcagatattcggtatttttaatctccatggaaaccttctccgattcctgcagcacttcctcctggttcttaaaatcattccggataaaattccggataaacctggtcttcttcagctggagattttccttttccttttgttcattggcctctaccagcatctgaatcccgttttcaatactgttcaggttataattggtttcctcctgggaatccagcagctgattcattttccgtacctttaacgccatcttcctggatagcaccacaagcagaagcgccgtgggaattgcgcagataatcagcatccctatgattccccactgtccggtgacaatcttatcataaaaaatgtccatatcctgcagggaacaatagagcatcccgctgtctccctgctgtactgtcagcagatatttttctccatccagcttaacctgcctttgctccccggattcttttatcagctccaacagcgccgcatggtctgtttccctgctttctctggatacaatcacttcattatcataaagaataaaatcagaccgcagatcctcagcctcatttatcataagagaatcgtaataggtatccggcacaaaaaatacaagtgtttcctgaaatttgggaggaatggcctgcatataaagcacaattctggaattcccaatatatttctgcacccagaagccggaaaccgactgctcaggaaagacacgcagttctttggattcggaagacagctcctcctttaccgtctgtgcatccaaccgctccattacacagccctgctctgcaaaataatcggaatccacagaggtagtgctgctgtagagataatcatcctcgtgatattgataaagaagcagccgaaagaactgactcaccgtagtatattggaacagatgcttttccagctgcagagcggccagaggtttttctgaaagcttgaatttcgtcacctccgcagccagtcccatctggtatacaatatcattgattatctgtatatcgttttcatgcctgttcatttcccaacggagatgctcctcgttggaaacaagaaaatccgtatagatcgtcctgtaataaaaacggtacagataactgccaagcacagtaatgatcagtattactatgatactgaaggcagcgatatagtaaaaaacgttttgtgatttcagttctctccagatttttttcacagacaggccccccgcttttcatgttactgttcactccgtgaacagtaaccttttcatgtcatccttatcgtctttctcctttatttataacatacaaactgctctgccgccatccgacagcagagcaacacgtatttatttcgatttattccaagtccatggtatcaattgcatcctgatacatctgtacataatctgcagctcccatcccgtcaaacatcgatacaaaagagttccagctgtcgtccgtcacacctgtggtaacgaaagcagcaatgttttccacaactgcattattgatatctgtttctttcagcgtgctgtcctgaagctgctgggaagtgagcggcgccatatccagatagtcgttggaatatttctggatgatgccggctgcatcatatttctcacagtattccgtcttttccgtacgctgttcgggcatattaaagttttcagcaagataatttccgggtgcgaagaataatgtattacagtcaatataattcttcacttcggcgctgccgtcattggtaacggtgattttgccgttttcatcatatatccagccaaggccgtctccggcatccttttctccgtagtagagggagaacatggtttccgtgtccaacagggcatccagccagcgcatggtagccggcacatttttattggtgctggtaacaaacgcaccgggcttgcaaagctcaaggtaacgataaaggcttgcgctgctgtccggcgtccagagtacggaattggatgccactccgtcgtcataggccattgccagcagtctccaggccgtgaagaagcccacatttccctctttcagcttcgtctctaccgtattaaaatcctgggatacaatttccggatccacgagtccttcttcataaagcatgtgcagccattccatacagtcacgaaagccatcctgtgtggctaagaactgtaccttcttatcgtcatcaatataaatccatttatcagggtcgcagggaagcccgaacagagggagcatataacggataccgttaaatcctatatccagtcccatctcaagagggatttcatccgcctgcccgttgccgttgggatcgcctgtcttaaatgcgcgcagtacctcggtcagctcctccacattggtcggagtttccagattcagggcatccagccattcctggttaatgaagaaatgctggtttgtattgattttctggcctaccaggtagcctaccgaataaatctttccatcggaagccacaagactggttgtgggatcatccgcttccgcatcccttctctccgtataattgggcatatactggttgatcagttcatccagaggcaaaacaattccctgggttaccccatattcttcatcatccaccgctccatttccgttcgtggcgaggataacatcgggatattccccggatgcgaaggccaggttcagctttgtactccagtcagagcctttaatcacttcccattccgcatgaatgcctgtcagttcctccagatgtttaaccccgggcatctcgtcaaaattcgtcagggaatccgaatcacggatggctatcataaccttcaaagtaatcggttcatttacaatgggataacctgtctcgttaaaattaccgtctgctgccgctgccgcagaactctccgcagcacccgatgccgtttctcccgatgccgctcccgtggcctgtgttgtcccggaagagctgccgcagccggccagaaccgatatggtcatggctgctgccgtcaaaagtgcaattgctttcttcttcataaagaaaaacctccttatttttattgcaacactgttcgtgttggtttcctttttaccaatctgtaaccatcatccctttaaggatccaatcataacacctttttcaaaatacttctgcatcaatgcatataagataaccaccggccctgtcgccaccacaattatgcagtatttggaaacgttggcaatacgcatggcctcctgcatggatgccgagctgtccgccatggacatcatatagtctccggacttatccacctgcagggttgccagaatttcccgaagcaccgtctgcaggggaagcaggttcctgtcacgcagataaaccaggccattgaaataatcgttccattttgatactccataatacacggccaggacagcgataatggttttgctcagcggcagcaccactctggaaaaatactggaaatgcgtggccccgtccagcatggccgcctcgtacagttcacccggaatgttggtctgtatgtaagtacgggcaaccatcagattccatacgctgacgcagcccatgagaattattatggccctcgtattatataaaccgatatttttcatcaccaggaaggtcggaatcagccctccgttgaaaaacatggtgaatacgaagaaaaagttaaggaatcccttccctgcgaacttaggcctcgacagcgcataggctgccgccaaagtcaccagaatactgatcaccacgctggcaaaggtataaaaaagggaatttccataggaagaccacaattccttatacttaaataccgattcataacctatcagggaaaaatcaaccggatgaaagataacctctccccttacgatcgcatccggatccgatacggatgcgatgcagaccagataaagcggatacagaataatcagcatgaccacaatccagaacagggtattaaatatgtggaaaacccgattgctgaagcctatctgttttcttgccttttttttcataatgataacctcacaatcctttcatcagaataatcccacatccgtcatacgtttggacagctgattcacagacacaatcagaataaaattgatgatattgataaacagcccgattgcagccgtgtaggaaaactgtccgcttccaaggcctacattgtatacatatacaccgatgatatccgatgtggggatattccccggcgtctgcatgaccagagccttattcgtatcggaggcaagcattttgccgcagtccagtatgaacaccatcattgctgtgggaatcaggctggggatatctatgtaccggattttctgccagatactcgcgccgtcaatttctgccgcttcatataaggataaatcaattccggtcaatgtggcaatataaaggatcgttccgtagccggcagcctgccagatccccgatataatataaatcgaccggaatgcggatgcgtccgacataaagtcaatcgcctttaatccgagcgccgttcttgcaaaattaaggattccgcttgtgggagaaagaaaaatataaagcataccggcaagcactaccgtggaaatgaaatagggaacataaatgcttgtctggataaatctctttttcttcgtcccgcggatctgattcagcaaaatagccagaatcagaggcaccgggaagctccacaacagataatacacattcagcagcaaggtattggacaacaatctcttaaaatagtaggcgttaaaaaaattcttaaaatgctttaaccccacccaggcactgcccgcaataccatccaccgccttataatccttaaaggcgatttggataccgtacaacggcagataattgaaaaccacgaaatatatgaccgccggaagaactaaaagatataactgccagttattctttaatactgctttcaggcccagcctctttttcatggctttcggttttcccaatgctttcactaaaaccgctcccttcttttttgtaacattcatgcacctttcatgtcaaaactatacaaattattcgtcactttttcaacgttataaattttatcccctttatcagaccacaaaatgaccgttttttttcttatttgcgggcaatcaaaggcgcttcttacaatcattcagccgcaaaaaacagggaatccttccgattcccaaattttataccgcctgaaatttataaccttcctgcattctgtctgtctaactgaccctggccgcaaaaaaaatatgcataataacagacaaaatgccggtatgcatcggcccctgccaatgcataccggcatgtactgctgaaattatctcattcagccggccggagcgagttcaattatttcattacaatatttatatctactcgaaaatgttgattttacgctgtttttcgctatctatcttatgatttactccatttttactccaattttaagccaatattttcagttcggctacttcttcttttttcttttcttctgaaacgtgcgtgtataaatcggttgtcattgccaatgtggagtgacctaagagtttctgcactacctgttggtctactccattttcatagcaccttgtagcgtatgtatgtcgtagagtgtgacaggtaaatagttcaaatatcttcggctctctcttttcttcctttgccagttcaatctctattacattgattttcgctacatagtctttgattgcactattaacgttgtaatagtaaactggcgaaccgtctgaacaggtaaataccaaattttgaaattctttatgctgtttccatattgagcgtttccacatcttctgttctgtctgctttatcttctgattttgcaaaatctcatatacttcatctgtcataggaataacacgattgcttgatatggttttggcggttgtgtagaaaaactttgaaccctcgacgggactagaagcctttgaataatgaattgtcttattgattgtaatttctcttttttcaaagtcacaatcttcccatttcagcccaagcacttctccaatccgacaacctgttgtcacagcaaatttcaaaacattgatgtgtatgtaggaagaagcaaatgtaaagaatttttcctgttcctctcttgttaatacacgcctttcctttttcacttctttcggcatttccacaccgatacagggattttttctaatgtattcgctcaataccgccttatcaagcatatcgcttaacataaatctgatattcgataccgttccatgtgcaagaccgctgtctatcaaatcattcaaaaacttctgaacgtgatatgttttaatgtcctgcaaatacatctttccgatagagttcttcactcttgaattgtagtaactgtggtttttatatatcgtagtcattttgactgttttcttcttatacaactccgtccacgttacataccatgcgtttagagtgatactttcgccattgccattcaaaccatgttcatcttcataaaccgcttctcgcaacttccgtttcaattcattcaatttgaaatcataaagcgttttacgtttccctgttttacttgtaaatcttgcaatatagcgtccgtctgctctctgtgaaattcccttaccgagttctttgccctttaaatctttacccataccaactttcctttcttctactgaaagaaatatggtaaagtaaatatttcaattttcattatatcgacaccccattttcttttcaagcccttttacattgatattccagccattcatcaagtaattttttatttgcatacagccgattaccaatgcgtaccgtaaatctatttttcggattgttcaacagttctcttgcctttgttttcccaatccccatatactcacaaaattcatttatattcagtaatgctttttctatacgattatcccctttcgcctaattttcttgcttttatgtaatcatcatacaactgcttctgtgtgatattcatttctccatttttcacaagattaccgatataatctctctgctctatcttcccaacctctgcaaacagtttcaaagacggggcaacatacttttctaaccactcccacaccttttgcaaacttttcttctgtggctgtatggtaagtttcaccttgcctatatctttcatcagttccgcccacgcttgataggtcggataaagcctttttcgtgttgtcgtgctgtctgtcggcttttctaaaaatcgtattttgctgtttaatacttccattgccagtcctgccacatctctatatctcaataatgcctgtactacacttaccgccatttcctgccgaaatctcaactcatatctattccaattttcgtctaattctgttccatactttttattctgttcatatcccttttcataaaataccaatctcaaattactggctgaactgccgagataaagactaccacctttactctgaaacacttcttctttcagttcccccgagtcgtgaaaatctatctcccttagttttgtggaaagcaatccctcttttgtccgtacaatcaaatcgggaatactcaaataaggttttctatcatctatcgccaaatcaatccgaggaaagttgatgtgatactgacaaactctgtttaagaaatcaaaccatgtttcctcattgagttgtaaaaaattttcatagttgcgacaacctttcccactcattaaaatctgaaagccttgatactgtgcatttcctgttggctttagcaccttgatattagcgaagatagccacaacctcatgtcctgcaatccccttttcatagcctgttaccgtcataagttccataggtattctcaacacatcttctatgactgcttctaacggaacttccttaatcgttatctgacaccaatctatcaaagcacttaattcttctttctgtcgtattactcccctgttagtgtaggggagttctggaagaaaacttccgcttctttcttccaaatttatcaaacctccttatctgcaacggcgttgccattgccctgccctcaacctgccgtttggtacgtcagaacgaggacaggaactttgaccgcctacatatttttgtttggaacagggcggatacccttacaggtaatcttctccactaatacagggaaatttcctctctgcacataaggggcataaactggttcttccagttccaccacagcataaggctcaatcttcggaagttccgttgcttccaagcgaatatccacgctgtttccaagtttcatgcttccaagatgaagttttaaggcttccacttcctctgttttcttcttactgtctttatcatagcggtaacagttatccgcacccataaagcgaagttctccaaatgcttcttttacctgttcttttgtcaatgtaatctgcatacacattcctttctccccgttgaaccgataggtcagtttctcatattttcattttcattttcctattacggcgccgttcattgttcagttttttctgaacttaattgtatattagcacaggcatattcgttttgcaatagaaagtttagttttttataaactttttgttttcttttttctgaacttgtggtatagtgtccttagacgataagatatgagaagttataacgagatatggaaagagagggtttttcagatgaatacaatcgcagaacggattaaatttgccatgagagcaaaaaataaaaaacaggtggacatagtcaaagatacaggtatcagcaaaggggcgttcagttcctatctttcgggacaatacaatccaaaagccgataaaatggaattgattgccgactccttagatgtagacttgcggtggctttacggagaaaatgtacctatggaacatacaagtaagaataacaatgccctgcaatatgtcttttataacaactcctgctccgagtatcttcttgataatttagacgatatctatattgccatgatgacccaatatgccgcccttattccacgcttttatgttcttgtcaatcgtgctggaaatgcaatgcacctattacctttatttttgaaagaagacagttccgagttctacgaatgtccgtctgatttcttctattccgacaggcatactatttttacaagagattttgaaagtattcacatggtattaacaaccgccacgatttactattacggaattgatacaaaaacttatgaaccgaaagttaccaaacttgcctactcacagactgacgattgcttttatattgacaatgaagtacatgattgtcatatcaaagcatttgaaaaagaagtggtaaaagaagcactttacttaaaacacaacgcccagtaacagacaagaggacttgcaaggtttctgacctttcaagtcctctgctgtatcatggttctgttggctgtgtccgttccgtcaaggactgccctacggcgtatcggctacgccttgttccttgacctcactacatttctctcaactttttagaaatcagtaaattgactgtaatcaatggaattactatacaaaagaaactaacggtaaaccatagtggtatatccctctctaattgaacacgaaaaagcagaataattgccataaatatggttcccaaaatctccataaaattcaacaattttttgcggaattcttgtagacgcatccgattttgtatcctttcagatttccatattccataatttacttgcatatcatttacatcttcatctgatataagttcatccatacttacatctagttctaatgccagtttttttgccgtaatcaaatctggacatcttgaaccattttcccaacgacaaactgtctgccttgaaacatataacttatctgccagttgttgctgagtgagatttttttcttctctgaattttttgatgttatcatttaatgccatactccatacctctctttcattcacatcatataacgatagaccccaaaataaaagtaccagtatgtatttcctttgtttccattttggtaacatctgtttattccaagttttctacaccataataccgatatatcgctgaaccaatgtattttgtaaccccttttccgtactgtttatctgtggcttcttccaactgagaatgattcaaataatctttagccatttctaataataatactcttgcattatccattttaaaaagatttttacaacttttccccaatctttttactgctttcattgacatatctttcatcgtaaccgttacgctactaaagagtcaagatgttttttctattttatcacaaattcaataaaactgcccctaattttacaaataagaaatgacgcagataatgtttccactacctacgccatttctcattacatctttgaaatatttactccattttctttcaatctttactccaattttactccattttaaaaatctgttacgatattttacggtattctatgatacctttcccttgaagaaaaatgtctgcaagccttgattttaagcgaacttttcaatattcccaagcactttattctgttgtgagattttctctcaaattattttatcacaatatttcttcaaatcataatcatgggacacaatgatacagagtttttccttcgcttcttccaccagcgtattgattatggcatcccggctcaccgggtcaagcgatgccgtaggttcatcaaacacaaggaccggcctgcccgaaagaagcgcccttgccacaataatcctctgcgcctggccgaaggaaaggttcttaccattctcttcaatcaccgtagcataaccctccggaagctccaggatcgtatcgtgtatattcgctttcaccgccgctttcctcacatcctcaaaagtcacgcgcctgtttccgtagcgtatattctcttccaccgtcccggtatgcaggatatgatcctggggcacataggaaatacagctgcgcatccctgttcccgtaattttcttctcatccagccatatggccacttctccctcctgcggctcataaagtcccagggcaagcttcaggaaggtggatttgccgcagccgctgggaccgaaaatccccacaatccggtttcctcccatttctctggtaaaatgctccatcacctttccttcctccccatatccgaaggaaacatcctgaaagcaaagcgtgggaaccgcgtctccatattccgcttccatctcctctgtctgcggctcttccggaatctccatcacctcgatcacccgcttcgtacaggccagattgttctgcagctccccgatcagcggaatcatctgtataaaaggccaggaaatataattgctcacctgcaccagccccagcaccgcgccgatggacatttccccccggataacataccaggcacccaggccgatcgccgcaaaattaatcataatgcccaggaaaccgctgcccgcattcataacagcctgaatcttcaccgatttcagctgttttttctttttgtccccgaacagctgactgaagtcctgcgccgatttttcatagcaggaaaaacatttgatggtgaccagggtggccagctgctcctgaagatagcctctcacctttccttccccatcctttgccttcagcgtccacttctgcagggcaggcatgaggaaattgctgaaaataacaggcagcggagaaagcagcaccaaagccagggcgattttccaattaataagaaaggcataggcaaacgcgaataaaaaggaaaaaattcctgccgccatattcacaatagattccggaattaccctggcgctttgcgccgaatcctccgtcagccttgtgagcatatcgccgctgtggtaggactggcttttttccaccgggattttttccatatggataaggagcttttcccgcagcctcccatccagactcaggatggaattattctgcagatacagcttaatcccatccagcagcatactgacaaggcctgttagcaccaccgccgtcatcaggaaggaaagaggcgccgccccttttccctgtgccttatccacaatcagctgcacggcaaccgccaggcatacctgaaacacggcaataacggataccagcactaacaatcccagtatcattcctcttttctttttcgtgagtgaccaaatccatcttatctgtttcataatccaatccttacctctctcgtccctaattccggacaatccttctggttttcaagctgaattcaggataacatggttttctggccccttcacgcaaggaacggttgaggaaaccgagagtggaaattctttgtagtaaatatgggaatatgttaaaattgtaccggaacgcaaccgctgcgggcaatgcccacgccagcaacatgattggagaaccttatgctgtattttctgctttttgcccggactgatgctatcaaaaaagaacgggaggatttgctttcctccctcataccggaacccttccatatagaaaccgccctttttccggacggccccgtgagcctgcttccggaaaatcttccttcctgcttcctcattgacagaagcggtatgccggagcttcctgaaaatccctggctccagcttctgtccatccaatacccgttaattcccgtcctatattatgaggaagccgccgccttccgggaacagctggaaagcctgctcctgaaagaaaacgacgccaaccttccaaccggaaatccctgtctctcctacgcgaagagccggtcttttctggataacctgacctcactcggctccgccagcccccaggaggaccctgagcttccggattattcccatgtaagcttcgccgtctgcgccgcccgtttatccgattcttcctgtgatgatctggtgtatgaagcctgtgccatgctcacccggaaatatccgaattccttctgctatctcaaccggaagcaaaaaatcctgctctttgtcctgtatgagcataccgggaattttacccagctggaattaaaccgtcagactctgatggagcaggccgccgcaaccgatagtttcctccctccttttaagtttggagtgatacaccacgggctttccgggctggtctcctcctttctggaggcagagcaggtatattatgttaacagcccccgcgtccttactcccgcaagcccccaaagacaacaccatcacacccgccaacaaaaccgcaatcatttttctcataaacaaaccatcccttcactaacctcattttctctgaatgcattcaacttacccttgcattatagtttaacgaccatttttatcaaagagcattatttttagtaaaaataggtggttttttttagtttatgaattttcccccatttatttataaaatcccccaccctttccttctttttttggacataaaaaaagacccgaaagccttcctggttctatccgtgattagggtatgccgcctgcgccctctccgtgtatcctgcgggcctcccggccttcctgtccggcggcgttttctctgtatccaccgctgcatctcaaaaaaagggagctgtttcttactattttgatcctatactccgctgcccgcccctagcggcgctgtctgacgaccgaagggaggagtttaagccgcgttggcagcggagtatagggacaaaatagttagaaacagcccctttttttgtctgcagcggtggatacagagaaaacaccgccggacagggaggccgggaggcccgcaggatacacagagagagggcgcaggcggcataccctaatcacggatagaacctccacaccctccctcttttttatcccactaccttattccgtccgttccttcccccagaagaacaacgccaccgtccccggccccgtatgacttccgatggtcgtccccacataattgataaccaccttccccttcaatttagggaaacgctcctcaatcaaatcggcaaccgccctggcatcctcatagcaggccgactgggaaatataacacttgtcggaatattcaagcccgccgtccgcatactcttccatcttttctacaatagcctgtattaccttccgtttggtacggattttaaaccggggaataagccttccctgatcatccatattcaaaagcggacaaattgccagtaccgttcctataaaaccggatgccttggatatacgtcctcctttaatataaaaggtgagatccgtggaaaagaaccaatggttcatcctgagcttattcttttccgcccagtcatgcagttcatctattcccattccgccgtcccgtaagtcagccagcttatccataataaggccatatcccgaggaagcccccagggaatcgaccacataaatttttctgtccggataaagctcttccagttcctgctttgccgccagcgccgaattaagaacgcccgatatccctgacgacaggcataaatgcagaatatccttgccttccttcaaaaaaggttcaaaatattcccggaattcctctaaattcacctgggaagtcttcgtatccgctccaagcgtcatttttttataaaattcctcaaatcccatggatttgcccaaatcatccgcatactgcactccatccaactcataatgaaagcatatgtaggatatatccctctcacgaaaatgctcctccgtaagatctgccgtagaacagcagctaataatataatctcccatcctctccgcctttctatccttctgtcaggattctttctctactcagccgtataggcggccttgtagggttattataccctattccacaaacctccacaactccaattagccggaaattactgtggcataatcttaaaagttacaattcactgccccggtgccgccggccttatagtcctgcccgcccggcgcccggcattccctgccctgttttatggggcgcggccctgcaaggattcctgtatgggccgtataaatacgccggtccttaggttgcgtactttgcaaccttagtaccgttgcgtagttatccgagcgaaagcgtgccctgacaggaaccttgcagggccgcgccccataaaacagggcagggaatgccgggcgccgggcgggcaggactataagaccggcggcaccggggcagtgaattgtaactcgaaaaaacgaattctgaacagaatttttgtctcttttcaaaaagccggcgcactgcattttgcaacgcaggcgccggcttttttatgttgcttcactgcattattttgcagctttcgcttctttgattttttcggtaaggacaggaacaatcttgttcaggtcacctacgatgccgtagtcagctacgtcaaagataggagctgtttcatccttattgatagcgatgatgagatcggattcttccataccagccagatgctggatagctccggaaataccgattgcaaaatatacattagggcgaacagtcttaccggtctgtccaacctgaagatccttaggcttccagcctgcatcaacaactgcacgggaacagcttacggttccacctactgcatctgccagatcctgaagaattttgaagttctcagggctgcatactccacgtccgccggataccagaatctttgcatccatgatatctgctgtatcagcaacggatttaacaacttccatgatttccacatatttgttgttcggagtgaatccgggattgaactcttccactacagccttagcaccttccaccttaggagccttctgcataacgccggggcgtacagtagccatctgaggacggaaattcgggcatgcgatagttgcaatcgtattgccgccgaatgcgggacgggtcatcagcagctgattgtgcttctgctcctgtccggggataggatttaacgggaaatcaccgatatccagctgtgtacagtctgcggtcagacctgtatggattctcgcggagacacgagggcccaggtcacggccgattgcagtagctccaaccaggaaaatttcaggtttatacttctcgattacagatgccagtgcatgtgcatagggctctgttctgtattctttcaattcaggatcgtcaacaacgattaccttatcagctccataagcagccagttcgtcagcaagacccttcacatcagaaccaaccagtactgcagtcacttcagttcctaaatcttttgccagatctttacctttgccaatcagttcaaatgcgattccgctcactacgttatcaacctgctgtgcaaagacaaatactcctttatattcttctaaattcatccttattcaccacacttttctgtttattattaaataacgtgtttttcctgtaacttttcaacaatgaaagatgcagattcttccggagtatccagaactaccttctgtcctgcgccctttcttactttatcggaagccttggcaatctgtgtgggtgatcccttcagacccagattggaatcgtccacatcaaccagatttgctcttccccatacggtgatttctttcttgtaagcatcgaaaattccgccgggagtcatgtaacggggctcattcagctcgcccagagctgtgatcaggcagggcattttcgctttcagtacatgatatctgtcatcgaactgacgctcaacgattacgctgtcgccttccactttgattttctgtgcataggagacaaccgggattcccagatgttcggaaatctgaggtcctacctgtgcggtatcaccatcgatagcctgacggcctgtgatgatcagatcatattccagattgcggatagctccggcaattgtctgggaggttgcccatgtatcagcgccgcccagtactctgtcagttacgagaataccgttatctgcgcccatcgccatagcttcgcgcagaacctcttctgccttgggaagacccattgtgattacggtaacttctgcaccgtactcgtccttcagtctcagtgcagcttccagacctgccttatcatcagggttcatgattgtaagcatagcacctctgtccagcgtaccatcgggattgaatttaacgccgccctttgtatcaggtacctgcttaatacaaacaacaattttcattgtattcctctccttgttttcttatattctcttaacctcagcggtgttatttcaacagtgcaccggagattaccattctctgaacttcgcttgttccttcatagatctcggtaatcttggcatcacgcatcatgcgctcaacatcgtactctcttgtataaccataaccgccgtgcagctgaactgccttggttgtaacttccatggcaacctctgccgcatacagtttagccttggcagcttccacggaataaaccttctgggtagcttttgccatagcagccttgtaaaccagcagctgagcacattctaccttggtatccatatctgcaagctggaactgtgtgttctggaaagcgccgattgctctgccgaactgttttctttcttttacgtattcaacggtacgctcaagagctccttccgcaagaccaagagcctgagcagcgataccgatacgtccgccgtccagagtatgcatggcaataccaaagcccttgccttccgcgccaagcagattatccttggggattctgcagtcggtgaagatcagctcatatgtggaagaaccgcggatacccatcttcttctctttggtaccaaaggtgaagccgggagttcctttttccacgataaatgcagaaatcatttttttctttctgcctcttttatcttctacaacactggtaacagcgaaaattacataaacatccgcttctttaccattggtgatgaaaatcttggatccgttaagaacccattcatctccatccagataagcctttgtctgctgtccctgtgcatcggtaccggctccgggctcggtcagaccgaatgcgcccagcttctcgccctttgcaaggggaaccagatatttctgcttctgctcttccgtaccataggtcatgatagggtcacagcaaagagaggtatgtgcggatacaataacgcctgtggtgccgcagaccttagacagttcttccacacacatagcataggttaaaggatcgcatccctgtccgccgtattccttcggaaccgggattccaaagaagccaagcttagccattttttcaacggtttccctggggaactcctctgtttcatcaacctcctgtgcaagaggctttacttctttttctgcaaattctctgaaaagagttcttgccatttcatgctctttgcttaaagtaaaatccatgattaattactcctccgttttatctttattaatcgcgaaaaccgcgggctgtttacttgctgtaatcatagaagcccttgccggtcttctgtccaagctgtccgccacgaaccatcttcttaagcagtgtgtgaggacggtacttcgggtcacctgtttcagattccagaacctccatgatagccagaacgatatccaggccaatcatatcgcccagagccagaggtcccatgggatggttagcgcccagcttcatagcggtatcgatatcttctacggaagcaacgccttctgcataaataccgattgcttcgttaatcatgggaacaaggattctgttaacaacgaagcctgctgcttcatttacctgtacaggagtttttccgatagctgcggaaacctctttgattttttcaacaacgcagtcaggtgtattcagtcctgcgataacctcaaccagcttcataacaggagcgggattgaagaaatgcataccgataacgggtctgtcaaggcctgcgccgatttcagtgatggaaagagaagaagtgttggtagcgaagatacaatccttcttgcagatatcctgcagttccttaaaggtctgtttcttgatatccataacttccagagctgcttccacaaccagatcacagtctgtacagatggtctttacaccggtagtgattttagcgaggattgcgtcagccgcagcctgctccatttttccttttgcaactctcttctccagagcctttgcaattctgttcttgccgttagcagcaaattcttcattaatgtcgcacaaaaatacttcgtatccttctgtctgggcaaaagcctgcgcaataccggatcccattgtacctgcaccaataataccaaccttcatgttgtatagcctccttgtgttttataattgagccggggtacaaggagcaacagcccctgtacccggcggagtgacggattacaattccttatttattaagaaacttctccactttcctcttctccaggaaagcagccattccctctttctgatcataactctcgaagcaatcgccaaacagcttctcctcgattacaatcgcctcatccatatcggcatccaggccatcattgatagctttcttgcagtttctcacagcaataggcgcattctttgcaattccggcagccatcttctcagcggctcccatcagctcttcctgagtataaaccgcattaacaagaccaattctcagagcctcgtcagccttgatatttcttgcggtgtaaatcatctgcttagccattcccggtccaaccagacgggccagtctctgtgttccgccgaatccgggagtgattcccaggccaacctcaggctgtccgaatactgcattatcagaacagattctgatatcacagctcatggaaatctcacagccgccgcccagggcaaaaccgtttacagcagcgataacgggaatggggaaggtttccagtttacggaaaacatcatttcccttcttgccgaaagcttctccttcgacctttgtcaatgtactcatttctccgatgtccgctccggcaacaaaagactttgttcctgctccggtaagaatcagacatctcacttcgtccaggttcactccatcaagagtcttgtccagttcatccagaacctgtgaattcagtgcgttcagcgccttttcacggctgatagtaataaccgcataagcacccttctgctcataaacaatatattccatgccactctccctttcttatttccgccctcagacggattctcccgccattgcggcggttaatcaacaatattcagaaacctttactgcataacgaatgattagcagacaaaaagtccactaatcattcccttttaaaatgctatattaatctctttcaacgatggttgcacagcccattccgccgccgatgcacagagtcgcaagacccttcttcgcatctcttctgaccatctcatgaagcagagtaaccagaatacggcatccggatgctcctacaggatgtcccagtgcgatagctccgccgtttacattcagcttgtcattatcaatgccaagatcatgtccaactgccagagactgtgcggcaaacgcctcatttgcctcaatcagatcgaaatcatcaatattcattcctgtcttagccataaccttcttggttgcagcaacaggtccgatacccatgatagtaggatccacgccagccagtgcgccggctacccatgtagccataggtgtaacaccaagttctttcgctttttcttcactcataacgataactgcagcagcgccgtcattgattccggaagcattcgctgcggttacaataccatcttttttgaatgcaggacgaagctttgcaatgccttctgccgtagttcccggacgagggccttcatccttattgacaatgatggtttcttttttcttcttcacttccacaggaacgatttctgcatcgaattttcctgcttcctgagctgcaacagccttctgctggctccatgctgcaaactcgtccagctgctctcttgtctgtccccactgctctgcaatgttttcagcagtgatacccatatgatactgattaaaagcatcggtgagagcatcattaaccatggtatccaccattgtggcgttacccattctgtatccataacgtccctgaggaatcgcataaggagccatagacatattttccataccgcctgcaataacgatatccgcatcgcctgcgagaatcatctgtgcagcctggttcacacagttcaaaccggaaccacaaacaacgttcatggtaactgccggaacctcaataggtaaaccagctttgatagatgcctgacgtgccacattctgaccaaggccagcctggattacacatcccatatatacctgatcaactgcttcgggagcaactcccgctctgtttaaagcttccttaataacaatagcacccagctcagctgccggagttgtgcttaagcttccgcccatagtaccgatggctgtacggcatgcacccgccaaaacgattttttttgccatgttttctcctccatattcattaaaaagtgcgagtttaccgggctttaacggtattgttaattttttgtcattgcccgcagcatttattataacatagagaatatttattagcaaggatttttcgactcgaaatccaatgaaatacgggaaacttcccggttaagtgaaatgctctaaaaataatgtaaaaaatataaattttctataaaaaaagagactgtcgaacgtatcttttcattattaaaaggattaaaggggctgtcggttaataccgattttttacctctgacagctagtgaggagacattcccatagaatccgggctttttttaagccggaattctctatgggattgtctcctccttttgcagcttctattttagggcgcaaaacccccttgtctggattttttgaagcacatcttcggctaagctgctttctgctcctttttcccttcgtacgtttcgatttcatgatgtaagaaccgatggtatttcatgatgttgcgtccgatcgcatacagcatgaactctttataaactttctcctctgaccggtagttgaaccgacggaagctttcgttttccttgatatctccaaagtgtccttctgtctggatggaacggatctgccgtttcaaaatcccttcctcactctggatatttgcattggattcttcccgcagttcttcccagcgttcgttgatcttcatgactttattccggtctggattcttcccagcattgtatttataaagacatttggatttatgctcacaccccatgcagtccgcacagccatatacctctaccgtctgggtataaccctcctgctctttgctttccgtccggatatgacgcagctctcttccatcatggcagatgtaatagcgttcatcctcaaagacggcgtatgtcatgttgtaatacttcccgatatcttccttataagcccgggttttccgcttctcatgatccggaagcttgatatagcttcggatcccgttctctttgagatacagcaggttcttttcactgcagtagccgctgtcggccgtcaccgcctccagggtgtctccaaacgcattctggtgctttttcaaaacggggatcagcgtatgatagtctgtccggtcattactcacatatccgtggactataaagtaattctctactgcgatctggacattgtatgccggctttagctgcccgttgagcatatgatcctctttcatccgcatgaatgttgcttccaggtccgtcttggaatagctgttccggtcttttcccatgttctcgaagcattccttataccccatcaggcggctgccgcattcttccagttcctcatagagtttctgaatccccggcttatgtttcccttttccgaaaacgaattcaatcccttccccttgcgcaatccacatcaggtttttctgcagcttcaggatctcaaggggagaacagtggtcgatctcaatgagggtgttattggagatctttttatgctttgtcagtttccgtttcctgttttcttcgatgaccttcctgactttgtccattccttcgatcacgaacatatgggcatccccgagatcgtatttcgtcccatatccattctccgacaggaatgcgttgtacttggcataaagggcatcgatggcatccagcaggcaggcaaggtgatagttgaggcttccacgccagacgaacgtgtatctgtttgcgttcgcttcaagctttgttccgtcaatgtaaagctctttgagtgtgataaggccttccttctccaagcggcgcatgaactggtaattcagttcatccagggcttctcccgtcagcttttttcctttaaaatcgtaaaaaacatcccgctggggcttctgccctttggtcagccagataaaagcaagatctctctggcataagtctacaatacggtcaacagctcttaccccgcgcatgtttgcgtaggtaacaacagaatacagcatgattgggttaaacccggttcttcccttatctgaataacaggccagcaggcccgaaaaatctaattcctccaatacttttttcagggtatagactggatcgtcgtcgggtaggctcaattcgaagaaactgaagttgattttctgttgcccaatttcaaaaaagttgttataataatcttgtttttgcatagttccattataacatggaacggagagaaagatggttgttgttagccatctttttttctttttgaggaaatatttcaggggccggtgtgactcgcttgagtcacaccggcccctgtctgggactatctatttcccgacagccccctgttttcatctgttaattcaaaaatactgcgattgcacttgctcccggtcccacatgaacaccgattaccgaaccaactgccaccattttgttatattctgtgcccagacgttcgcggatgaaatcctgaaattctccgaggaactcattatttccggtatagcccaggttatagcctctggatttatccatgccgccgtccttttccattgccttcagcagcttctccctggcccccttctgtccccttgcaagccccgcaactttaacctctccatagcgcacagccagcaccggcttaaggttcagggcgcttcccacaaccattcctgtggcagaaagccttccgcccttctgcaggtaaagaagagtatctacaataaggtaaatacacaccttttctttttccttttccaatatttccacgacctgctccgcatttttcccttccttttgaagagcaaatgccctttctgtcagaagctgcgttcccagagtggcctgcatgctgtctataatgtatatccgttcgtactccacaatatccttagccaccaaagcgctttggcaggtaccgctgagtttgcttgcgagcaggatacagattacatcatcccccgcttcttttgcttcccggaaatactgcaggaatgcctccggtgacggctggctggttgtcggcagttcttccgaatctgccagcatgtcataaaaagcctccggtttgatatccacgccgtcaaaatattctttttctccgaataatactttgagaggaacaagggtgatgccaagttcctttgcctgctgttctgtatagtcacaagtcgaatcacaaataaaacgaatactcatctttcctcctgttaaaagcacatgccgccggttttttatatctgtattttatgcttcaaaaaatactttgatactcaaatcttttgaaagcataacaaatatactgacggctgtcaatgttattctttggcatttcccgccaaatcttataattctgcctgaaacagcagggaatcaggtaaaatagtttgctatttccggggctttttgatagaatgagtaagaaccaaattcgttacttctattataaagatgaagaaaaggatttacacatgaaacaggaaaacaaaaacaaaggatttaccttagtcgaaatgatcgttgtaatcgttataatcggaattctcctggcaattttagtgccgggtctttttaagtacataaaaaaggctaaggatcagcaggcgctgattgaatgccgggcggtggtgacggcggcgcagacaatagctcttgaaagttatggaaaaaatacttttgaacccgaatttttccttaacaataacagggcgcaaatcttatctgctgctgatgttgatggagaaattaatattatacgttttgaagatcccgttaataaagcgctggttacttatttaagttatactactaaaggaaacattaatgtaatttatgatatttcatctgcctcagtatatagtattctggatgatgatataggaaaaggacgaattgaacagataaccaagttatataaagatgcttcttcttcaacaagtacaagtaaatgggaagatgcgaaaaaagctttttatgggaatgaaaaatactcgggattaacagcagcagaattggctttattagaaaacaattgtaaaattccttccgctgacgcttctaagtataaatggaagccatgtaaatatgtagattccagcggaaatgttcaatttttattgtccgccactttatcaagcggtacgcaaagtactcctttagtatattataatggttcctattattattggcatggataccaaaaacctcaaacaacttctgtaactgacaagactgctgaatctgctgtagcccaactccaatccagcacttataccagtaaaaccattaacaatagtgtaatcgatgaatgggtgcttatcatacaataagttatcattctcagtataggcggttgaataacaaacaaccgccttttccttaccctatacgttcctcaaaatacctgcaatcaaataatcatcatcctcatacctattcccggcaatcctccccagcagcaattccacagccttctttgcaatagccgcctcattctgcttcacatgaagaaaaaccggcccgtacggcgccagataatcctcgtctatacaagccagacggatatcctgttccaggtcgattcccacctgggctgccgctgcggtaactacaggtacgataccgtattcttccgcgattaccgcgtctatttcccttcgttctttttccagaaacttccttactgcgcggatggcattcggatccggtctgttatcaaggaaaccttcggctccccttccggaaggcaggacgcagattcctgcctccgtcaaattcaatcgttccatttcattgataaaaccatttctccgttccctgacagagattgcttctgtatcctccgtagtaaaaaaagcaattctcctgcagcctttttccgcaagccctctgactaaggccgctgccgccgccctgttatctgtacgcaccgagggcaccggtataccacgcaatttcttgtctatcataaccatgggaaaatcgtccagatacaattgcaggattgcggggctgtaatgcttcccgtggcttggcataattattattccatctaccttcatggaaaaaaggaagcgtatttcttccgtttctttttccctgtctccataggagaagcggactatcagtctgtaaccagctttttgggcaatcctgtccatctgatacatcatctccaggccaaacggagtcgatacgtgttccagaacaagccccaacaaatgtcctgtcccttcgtttctgccttttgttcccgctttttcctttttctctacataggttccttttcctggaactcgttttacatgaccgctttccgccagcatttccaacgcctttttcagggttattgcactgaccccaaactcttcacataactcttcgtcactgggaagcttgctgcccggtaaatatatcccgttcctgatccgttccagcagttcatcatacaccttccggtacagaaatacctttcccatatctgctctcttttcctttccgaagccgctccctgaactcccggctcccggctcccggctcccggctcccggctcccggctcccggctcccggctcccggctcccggctcccggctcccaattttatcatctgttttctctcacgtaaaatcaatgtatattaaaatatattttttgtcaaatttcttttctttccatctatataaaatatatttttaacatattttatatgtaattatatccagtattttcgcacatttttagatattctatagaaaaaaactgctcatatttacaatatatatttaatatgctacctttgatttaaaggaactatcccattcgccccaaaggaggcctatatgaatcaacaaaagaaaaccagtcccttccgttatgctgtcggtatgttcggcacctctatccctatcaatatgttcaaaacctatgctgctgcattatacgtgatcgggcatggggttaccacggctcagttttccatggtgctgtttctttataccttcgtggatgccatcgataatcctgtctatggtttcttatccgaccgtacgcggacccgatggggacgcagacgtccctggcttgttatcggcgctcctcttctggcactctgttttatcgcgttctttaatatacccgctttcttaagcggcagcggaattttttcctatatgcttcttatgtatatcctcaccggaactctggattccctgatcaatgccaactacggcgctctttttcccgagctgtttacctctgattcccagcgggccaaatccaatgccatgcgtcaggcttttcagctgctcgccatggtcatcagtattgctcttacaccgcttgtaacggatgccctgggctatggcctgaccagcattatttatggaatcctggcggtagccgtcatcctttactgtacgtttggatgccacgaaattacaagaactgaggatctccagaagccccgtctgttttccactctccgggatctgctcaccaatccgaaattctggattttcggccttaccaatgccttttacagcgcggccatgtctctggttatgtccgcggttcctttctatgtaaaatacacgctgggacttggcagtatggcaaatacgattcttctcggcatggtgcttctgtttgccatggccggagtgtctgtgtgggcgctttttgtaaaaaagcattcggtgatgccggtatggcgtatcgccctgatcgccttgaccgtttcttttcttcctctgtattttgtctccggcctttttcctgcacttgctgcagcctgccttctgggcttcggttattcaggggccatcactaccatggatttaatcggcgcccgtatcatggatgaggacacccggaaaaacgggctgagaagagaggggacttatgcgagtgccatgggatttatgaacaggctgagcggcttttttaccagcttcgccttcctgattgtaggccgtatctacggttttgaaagcggagagataccaggcccccgtccgcatgatgccgcgcgttttctgatggtggtatttcccttttgtgtcatgatcctcagtgtattgtgttcccgttttctgaaatttccggaagacggcggtccttctgcggcagagagtccggctgtacccggaaaggagatggaatgaatgaacgtttccttattataaatgccgatgatttcggtctgtgcaaaagtatgaatcaggcgatctgtgagctgttccggctgggtgcaatcacctcctcctctatcctctctccggcacccatggccatgaatgcctgccgatatgcaaaggaaggcagctttcctgtgggagttcactggactcttttttcagaatggaaggaagaatgctggatgccttcagataaagaaaagagggattcctcattgactgtgaacggcctgctgcctgctgacggaggagcggcagcaaaacgggctgcctcaggtgatgtgacgcgggagctggaagcccaataccggtttatgacggacgccggctgtacgccggatcatgccgacagtcatggagggactttatatggtatcaatggaaggcttttctttctcaacgctttccgcctttgccaaaagtaccgtcttcctttccgttttgcccgttcccctgcatttctggagcgtcagttcggaggaaaggtatcccccgcattgaaagccgcccatgccgcagtctgctttcttgccgaccggatgaaggtatcgctgccggatgattttattacacatcctcttcctgtggaaaaaatccgggattatgaagccctttgttcttattatgaagagcagcttgccgcggcgcctgccggcataagtgaagtattcctgcatccgtccgttcccgatcctgttctttccctgcggacacctcaatggaaaaaacgggaatgggagtatgaatttttaaaaagcggccgcctgaaccgctttttggaaaaggaaggtttccggctggtttcctggaaaagtgccccgttcccatgcaaaaaggagaatttatgaaaaagaaaatacagttacagttatttctcgacaaatcccgggaaagggagtatatccgtcttcctttctctgtagatgcggacacggaaagcatttccatccgttatcgttatccatcctcttttgcagggcaggatggcccttttgttattgaaggggaaccctgcacgattgatctggcggtcatgatgcctgacggcagaatggcgggatcctccggttcggatcgcagcagcatcctgatttcccctctgggcagcagcgcgggctttcaatcctgcgaactgccggaaggtacctggcatatcatagcgggcgcttatcatattccagccaatggtgttgccgtagaatacgaagtggaagtaacgccaaaggaacgccggctttttaagggtgatacccatgtccataccaccgcttccgacggtattctgaaggcagaggaagctgctctgctcgccagacgtatgggattggatttccttatatttaccgaccataataacagcgcccagaatgacaggtttcctttttatgaagatatcacgctcattccggggactgaatggacacattataaggggcatgccggttttctgggcacagaacaggctttcagtactccttttttcaccgcttctttggaagaaacaagagatttattcaaggaggcaggagaaaatggggctttccgtgtcatcaaccatcccttctgcccgttggttccctgggaatgggatttttctctgcccttcgacggtctggaggtatggaatggcgtcatgtccgagcggaatgaaaaggcagccttctggtggcatcagcagctttgctccggccggaagctgccggttaccggcggcagtgattatcatcgtcccggtcttctgggcagcctcgccatgccctgccagtgtctgtatgccccttcccgttccagggcggatttgctgaaggctctgcgccagggcagcggttatgtttcttatctgccctccgggcctcaggcagatttcgctgccatatctccggaaggtctccccgcctccttcggggacgtcgccgtccgcggagaatatacggacattctgcttaccggcctctgccagggcgatgaaatccgcctgattaccgatacggctgcggaatctctgatcgctccttccggagcctgtgaactgaaactgcgaagacgttttccggatgccctcttccttcggctggaactgtaccgaagctatgctcccggcctgcctcccatgaaggccctcctcactaatcctgtatactaccaataacagaaattcctatcagaaaggaacagaaatgaatacagctgccaagaaagtaattgttgtttttaaaacccaccttgacatcggcttcaccggactggcacagcaggttctggacaaatactgtctggatttcatcccttctgccgtagatctggcttttcgtgtgaataccccgcagtataaaaaatttgtgtggacggtgggctcctatctcatccggtattattttgcacatgccgatgcggccggctgcagcaggctggaacaggccatccggctgggatatgtccgctggcacggactggcctgcaccacgcatacggagctgatggaccgccggcttctggattatgatctctccatttcacacatgctggatcagaaattcggcatccataccatcgccgccaaaatgacggatgtacccggccataccatggcccttgttccggctctctgcgatgccggaattgaattcctgcatataggagtaaatgattcctcccgcattccttccgttcccggacttttccgctggcgcgccggagagcaggaaattgttgtcaattattcagcctcctatggagaatccactttcctggaaaacggaaccgtcctggaattttatcacgcccatgataattccgcaccgccctccccagaagagttggataccctttaccgggacttggcacaaaagtatcctcatgcgcatatcgaagccggtaccatggatgaattcgccgccgatatacgtcagatccgggaaaatctccccatagtggaatcggaaatcggggatacctggatacacggaattgccaccgatcccttaaaggtatcccaattccgccggcttatgcttttaaaagaaaaatggattacagacggtctgctgacacctgacatgcccgcttaccacagtttcatggaaaacctgctgttaatctgtgagcatacctggggaatggatacgaaaaaattccttctggacttcacccattgggaaaaaagtgatttcaccgcagcaagagaaaaagacagcacgggttatgaactgttttccccgcagaaccagcatatatttcaggcactgctgccggaactggaggcatataaagaggaacggggaggagccggatcctcctattctctttttgaaagttctcatcaggaacaaagaaactacgtgacccacgctctggttgcgcttccggccagggaggctgccgaagcccgcgattttctttcctttacttatcccgggattccctccggagcacatgaatgtcctgtaaattctccatttgcagccggaccttatcaggtaaccgtaggagcttacggagaactgaccagcctaaaggatatgagaaccggcctgagccggaaggtatccatcgggcttctggaatatgaaaccttcggcggaaaagaggcagatgactgttatttcgcctacgggaggaacctgatacagaacttccactgggcggaacctgatttcggcaaacccggactgcgttatcatacacagatcgggcaccattgctatcgtccctttcctgaatccgtccggttttggaaagatacgctctatgttactctccttttcccggaggaagcttgtgccgaatatggctgtccgagagaagccatggctttgtatcgttttaccgaacagaaaatccatatggagctttactggaaggacaaggatgccctgcgaagccctgaagcgctgtggctggaaatctctccgggcggtgacaatcctggctgctggaaaatggataaaaccggactgcttctttcccctgaaaatgtagtacataatggaaaccgccagctgcatgccgtacaatcgctttcctatgatgccgctgacggccgcatccggatttttcccctcgatgcccctcttgtttccttcggagggaaaaagctgtatcagccggataactgccttccggatctcagcctgggcttttccttccttttgtacaacaaccggtggggcaccaatttcaagcagtggtttgatgaggatatgcggttttcctttgatattcttctcacctgtctcaattgaagtacagggcatgtttgtatttcggccccgttgccatatttctaagagaaatgatataatatgcaataaacaggaggaacaggcaatggattatgatatgcttttcagcattggcgaattggcaaacatatgcggcatcactcctaaaacattgagatattacgataaactggggctcctgaaaccggcctatataaacactacgaatggttaccggttttatacccgatggcatataacccgtatttcaaccattaagcagctgcagaatatagggatttcactggatgatatccatacctttttcatgcaggatgatgaaacaaatattgtcggctgcctttccggattattgaagcatcaggaaaaatatattgccgcacagttaactgaattagaacaaaaacagaaaaaaatccggtctttacaattacaatgtgaaacacttaaaggaaagacagcctatgatgaatccaccggaattacgatccggcctattccgaaacgcaggatactttatacgtcatatcatggaacatatacaccagtcctgttcaggaaatgctatcaggaattactctcagacataaaggctgccggttatgatcccggagaaatggaattatccgcccccttatctattttctgtatatctgaaaacaggaatgacagcggtaatgcagatatcaaattaggctatgaaatgaataaccggcaggaggtttctctccctgccctatatctcgatgaaggtttatatgcctgctgtatttgcagaggcccttatgaccggttaaaaacagagttaagccgtactttgcatgaaaccataaaagatatgggctatcagatattctctccgcagattacgtattattatattcatgaagcgattgcagaggataaaaattatcttaccgaaatccagattcctgttaagatcatggaaatttaattgactttgtccttagggcatactctattctctccttatcaaaaacaaggaggaacaggatgggatattcaattttccaaaatacgatggtcgatatgacctacccgcagatagaagaagagattaaaaagggagcctgtgcgctgcttcccatatcggttgtggaagaacacggtccgcatctgtgcaccggaacagatatttatttaacccaggctgtctgcgtaaaaatcaagcagcagctaaacgccatgggtaaaccggtgataatagcaccgcctttttactggggaatcaacagtattacagacagctttgtcggttcattcactatcagcgccgaaacaatggaggccctgcttttggatatactggcgaatctgaagaaatggggcatacataaaattttcatgctgaattttcatggggattatgttcatatcagaaaaatagccgaaatagccaaaaaggcatatatagaaagaaaaacagaagcttacttcattaacagcaaaagcacattcatgcagttcggaataaccgaagaggctccttatctgctcaatgttccccttaatcagaatctgttatcgtccatgggcggtgactctatagacatccatgccggagctgccgaaaccagctggatgatgcttgattatgaagaattggcggatcccgatattgcaaaacagctgaaggccaccaatctttcgatggacgatttaaggatatggctgcatggcggtaattcagcaaaagaaattactccgtcaggatattgcgggaatcccgcaaatatagatctggatgcaatacaacgcatagaaaaagaaacgtcagaagctttcgcttcctatatatacaaagtattataaataatgaatttatgtatccggaagaaaagaaaaatggggatgcccaataaaatccgccttgacaataatgccaaagcggattttaatcgtccctgctgccacgataatacctattgtgaaaatatatgggcgcatatgaacaatatactgcatcagttcccttatcattcaccggataaataggcagaatatgtaattcccacattccttttaaaaagcttcccgaaataattaggatccggtatccctaccttttgagccgtcatatacatgatggttcctttttttgccagttcttttgccttctccattctaacctcagtgagaaatgcggataagccttgtcccgtttcttctttaaatttacggcttaaataagaggaattaaaaccaaacattttggaaacagaggttaaattcagcgttttgtcctcatagttgtctttgatatattttataatttcctctattgtaatactgtatccgcctatttcatctatcgtttcatcgggctcagcctgatttctttcatcatcaagctgtcctattattttatggagagtatcgttgatttctgctcttacgattggttttaaaagatagtcgctaactcctattccgatacattccttagcataattaaaatcttcatatgcagtaagtataatgatttttaatttcggatatctcttgattgcaaatctcgcaaattcaattccattcataaaaggcattctgatatcaacaaatatgatatcaggacgtatttcatcaataatgttaatcgcttcaatcccgctcgccgcttccccttcgacacgcaggttcatctcttcccaattgattgttcttctcaacaaacatctaattgccttttcatcatcaacaatcattacacgatacatgctatccctctattccttatgcttccatttgaatataaatcatctattcgtattttaattcttcaagcggaatgtagatctctacctcaaagtaatatcccacttcactggaaattttatagctgactttgttgctgtaatacttagaaattctatccaatgtactttttaatccaaaactctgacttttctttgataatacctcggatatcctctcctcacttgcaccaatgccagtatccttaactgtaattaccagcttatcctccttctgttttgccttgatataaatatctccttcttcccctttcggtatgatgccatgatagagtgcattctcaactatgggctggagaatcagtctgggaatccgaacattctttaccttttcgtctatatcatatatatcatgaaagatatctccgtaacgtaattcctgcaatttaagataattctttactatttcaacctcatcggaaagagtgatttcctcctgacccttgctcagaaattttctataaaatttccccaaagtttcaatggcatcataaacctcatcgcgcggattttcaagtgccaataaagcgatggtttcaagggtattatacagaaaatgtggtttaatctgttcctgcaatgcattcatttccgctttttgatatgccttttccttttcaacaagttcttctatcagtctgttgatctctacaagcatggtattatagctatttttcagttctcctatttcatcattgggcaactttatgcttactcgtctcagccatcctgtttttacttccctcatggaagagacaagactctccactggattcgtaatagaaaactttataaacagtccaagaataaaaaagccgaaaagagtaaccagtataaatactatgattgaaataataattcggggcgcaacaaactgaaacgcagacgtataatctttttctgctaagacaataggtgtattggggatgttcttaatgaaaacatttttatctatagctgtcacctggcaggatatgtttccttctctgatttcatcggaatatttttccagcttttcagagccctcaatgatatttccctggagatcaaatacggtaaactccttttccgtatcatcaaattctgaataggaactctttaatatatcatcgaaataattgataacaataattccaacaggtttttgtgaatttatatcatatatcgtacgaatcagggatattaccggtttacccgatatctgacgaaaagctcctcccccatttatttttatgatatatcctccgtttgcacggttgatctcttcatgccatgcggaatccatcatgcttttatctaaatatgttacgccattatttatactgatataaataccatcatttctgaaaatatagacggatgaaagggctttttctgctatagtaaattcataaatcacggataaggcatcataggttattcccaatttatttacatcatcggtatttaaaaaatataagacctccttgctgttcatgatccatttacttaccgtactgccgcccgagaagctgttcataatatttttctcaacggaattgagtacatctttattggcattatagatgtattcatccatattggctttgattataaactgatatattgcaaaaataacaagaacataggtacacaaaattaccgcaaatagagctgttgtcttttccttcaatttgcgtgaagaataccattctataattttgtgcacccatgttctcatattatacctgctatctaataataccttataatcctgtctctttttcttcctctccttacccctttatcgctccggccataagagacgactgtatttttttactcataaataagtaaatgattaatgttgggaaggttgcaattacaagtccggctccaatggggccccaatccgtcgtgtaagctcccgacaggctttggatacctacagacagtgttctgtattttgaatcactgatataaataatcgcaaacattaattcattccatgcctgcaaaaacgtaaatatggcaaccgatgcaaaggccggtttcataagaggacatataatcacccagaatattttatatattccggccccatctatgcaagcgctttcttccaattcaacaggaatactgatcataaaagaagagcatatcataattgccatggcaagagcaaatgcaacgtaaggcacaatcaggctctgatagctgttgagcatatgaaactttctcagtataataaaaatcggaagaatcgccgcatgaatcggaacggtaagtccaagcataaacaatgcgtttatttgttttcttcccttccatatcatacgctcaagggcataggcagccataagtgaaaataaaatggtaaatagtatggtaagtccggttacgacacagctgttaaagaaatacagacccatattcccggctatcagcgcttttttatagttagaccataaccaatgcttcggcagcccaattacatttgacccgaaaatttcactattatcttttaaggaaaacatcagcatataataaagcggaaacaggcttacgaatgtccaaataatcaaaacagtatatttgaccacgtttttcacattcttttttgttttcatgtcactctccttccaccttgaagattctcttaattcctatggcaaatgcaaaacagaggataataattatcacggcaactgcagaacccaaaccatattggttgcgcccaaatatcaagttgatcatcagtgtggaaggcacttcggaagcatgagagggaccgccattcgtgagtacataaatcatgtcaaatgtcttaaacgaaccaacgactgcaaatattgtacacattcttataatcggcttaatctggggaatgataatccttgtattgatctgccaggaagttgcgctgtctacctgtgccgcctcaattaattccctcggaacggatttgattcctgcatagaacagcagcatatggtatccgataaattgccagagaataggaaccatcaccgcagccaaagccgtcttttcttctcccagccaggtgtgaacccagccagacaagccaactgtctttaaaaaagtatttaacaagccataattgggattatatatctttaaccacaactgtccgattaccacactggaaattaaaacaggaataaaaaatacacttaagaaaaaacgttctcctttgattcctttcgccaatatcagggccaaaccaagagaaatcggaagctggatgaaaacggaaaaaatcgcgataacgactgcatgccacaaagttttgggaaactgaatggacgtatctttaaagagattaatgtagttgtcaaatccaacaaatttccccgtcgtcatgccatcccatttcagtaaactgtaataacaggacataaaaatcggaacgatgataataataacaaaaagtattgtagccggtaaaagaaatatgatcagtgctgttttattcttccttaccttatccatgctgcagcccttcctttcaaaagcttcctccggcctttccacagaccaaaggaagctttatttatctcttactctttcgtgctgtctaattgatccgccattgccttcacatagtcttccggtgtaattccgcctgaatacagctgctgaagaagttccaggtacttattggcatcctctgcgggaagaagtgtatcaaaccacagtgtaaaggaattcgccttagtggtataaccggcaatttcttttgtcatcggttcaactgcggaatcatcataatctatgttccaggcaggaatggcaacaccctcaaggtatgcgttcttagaaatatatttggcaatttcaaatgccgcatcacaagccacttccggatatttggttgatttcgcaaccataatggtatcggaagctccgcccataaaatcgccaagtgtggcattgtcagaattcactaccggaataggggcgacgccaaatgcctctttatcataagatcttgtattaatatccccgcctaaccatgaaccggtaaagaacatggctgcctgaccatcaaggaacggctgaacggcttcatcattggaaagccctgtggctccttcttcaaaagcgcctgcctcattcaattctacaatcgctttcgcggactgaagcatatccggatcattatagctttgtccttcctgcttgagcaatgcgttctgcagctttgtcgggcccgcagatttcaatgtaagcccatcatgaagcattccaagtacccaggtatctttcaccgaagtggaaataggtgtaattccggctgcctttaaggtatttactgctgcaagaagttcatcatatgtagtaggaacggccagattattctcttcaaagatcttcttattgtagaacatcacggaaaccggtgtggtaaaggtagagccatagatttttccatcatacgtctggtttttcagggcagcttccggaagctggtctttataattcgcataataatcatcaagcggaagaacctttccggattctgcaaagggctgtgaaaaacctccgccaaaggtgaagaataaatcgggcagttcattcgccgctaccgcagatttaatctttgtcttatatgcctggttctcaaatgtctcgaacttgatcttgtagccctcgtggttcgattcccactcttcgatcgctttcaggtaagaactgtgcatattatccgactcagtggcaatgctccaaaaggtaagggttttctcctcagcgctgctgctttggctactttggccgctttggctgtttccgctgtcactcacactatccttggtaccgcagcctgcaagcagacttgccgccatgatcagtgacaataaaatactaactgctttcttcttcataatatcctccttttaatcagcaattacatatccgtaatctgttatgggaatctgcataacacaatgcaattcgcaaagaatacggaattacgtgtctttattgttataaaaattatatggtattgcatattgaatgtaaacggattatttttacttgcatgtggattttctttacctgcagatattccgtataagtgctcgttttagtgaatcatcagattaaacgggggataaatcgttcaggaagtatttgattctgcacgaaagatttcagaaattacagaaattagcaaagcgctgaaggtcatttacccattgcagtaaatgaccttcaaaaattgattgatggatgatgagacagggttatcgggaaaaagaaaggggctttttcacagcccccttcttctgtcctttatttccgcagtcaaacccggataatatatccgtcttttctcgctttggcctggggatgcggttcattggaatagcccaggatacagtttccgatacctacgtattcctcgccaagcccccattttttcatgagggtttttccttcttccgaaaggaaaacctccttcgcacggtggatccagcaggagtccacgccaagggaagcggcggcgttcatcaggttccccatcaccaggcttccgtcctccacataggttcctcttgtgctgtcgccaaacacaataacaaccgtgggcgctccgtaaaaaggatctccgtcatttcccattacggcggcattcatacgggatatctgatttatggtatctttatcgcgtaccactaccatcactgctgactgcattcccattccgctgggagcatactctccggcttccagtatctgctgaagaatatcttccggtacctgctcctctttataggagcgtacgcttctgcgttccattaacgttttcaatgtctcattcatttccttttcctccttttcttttctaatttatataccaactccgccgtaaatgcggatcggccgtctgtttataagaaccattcatttttgcccctgatgtccctgaatggcgccagtttctgttccagaccggccatgagcggctccggaagcgatctggccttttccgggcaaatggatacgcaccgcatgcagagaatgcatttggcgggatccgttttttccggctctttcctggggattgcttccacagggcacttttctgcacaaagcccgcatctgatacaggcatcggaaaccagaggtaccgcctgcatgggattccagtttttataggggcggtttcccggcacgatgtaattcccgggctgctcttttccggaaagaatcccttcgtatttactgaggatctcttccgcagaccgtgtgatttcttccgcatcctcctgatcaggccttcctgccgccagctgtgtgacaatggaatgctgcgcggcaagcgccgctgatgccagccttctgaagccctgcttctccacactgtcatccagctcaatcagcgcgtcctcataagcacggtttccgtatacggccagggtcaccgcaaaagccccgtttccgtggatttccgccagcctttcgagcataactgcgggcaggcggcctccatataccgggcccgccactatcaccacatcgccaggcccaaaggaccgtcccgtattatggggcctggtcagatcatattcttctgtccttccagccatcgcctgcgccagaagcagggccgccttccgtgtatttccggccgggctgaaatgtaccacatctattttttccagcataacaacacccccttgtcttcccggaaagactcctgcttttcctccggcagttttccctccatccttcagtataggttcgtttttcccggatgtcaatcaaacccggcagcacttttccgtgacggaaatctgtaatgctgccgggtcacatatactgtttttcccgatatctatcgtatatcgttattcggttttcagactttttccaatatcagcctgtaaacgccctttttcagcgaaagtctctctctttcctccgccggcgtaccatttacagatttcacagccatcccttccggtacaaggaattctgccgtacagtcaaacgggatttccgcttcatacaggatatgatctccctcaaattcccatccgctccggtacaggccggatgccgatgcatactcgccttttacccaccggaagcgttcatccgggcagggagccagcactgcccttttaaagcccgctgtattctcgtccggcgcaatcccgcagacactccggtaaatccactcggatacagcgccataggcataatggttcaggctgttcattcccgtatcgcttatttttccgtcgggcagcaccgaattccatctttcccagacagtggttgcgcccatattcacttcgtacagccaactcgggaaatcctccttgaaaagaagggtataggcttcaccggaaagccccgccttggtcagcgccttgcaaagataggcggttcccacaaatccggtatttaaatgcatcccgttttcttccagcatttcctttaagcgctttgccgttctttctttaaacggttccggtacaatatcaaaatacagggcgagcaccagggctgtctgggtgtcaatcgccactctgcccgccggggttatgtattccctgcggatcgcttcccggacttcctccgccaccttttcataataggcctgatcctctgtttttcccagaacgcctgctgcctttgccgtcagaagggcggaatacagataatagacggaggctacataataaggatcggtccttccgaaacagctttttttatccgggttatcaagagccagccagtccgcaaaatggaagccaatctgccacagccttccgccgccgcagtaagtttcatccatatggatgataaaatccgtccacagcttcatattttcataattttcttccagctgggttttgtctccgtaaaactgataaacggtccatggtattaccgtcgccgcatctccccaggcacaggaaccggattccccccagatattttccgtaatatcaggcgcctcctgccccatattttccctggctgcggaaagcacatccggcaccacgtagggaacggagcctccattgatttcctgctcatagcgcatgtccttcagatatttgcggtaaaaagccgcggtatccatgtggaaacaggccgttgcacagaaaacctgcgcgtctccggtccagccaagcctttcatcacgctgggggcagtccgtaggcacatccaggaaattacccttctgtccccagacggtattttcaaagagacggtttattttatcatcggaggtggtgacggaacccgttctttccagcgaagaataaatggcgcaggcttcaaaacggaagctgctcagcatatcctggacaagcgttatcccgctcaccttcacatagcggaaaccatagaaggtaaaatgagggcgcacatgtctcttttccccgtcggcgatataggtatattccgccttcgccgtacgcaggttatccctgtaaaaattatcatcctgcaggatctccccatactgcagcgtaatttcggttcctttttccgccctgcagtcaaattccacccatcctgtgatttcctgaccaaaatccaacacctgttctcctgccggggtaataagcaggctggcaggagagaacctttcatgaatccgcacaggcacactcatccgctccgtcagctttccctcaggagccgccgcacgcacggcaggaaccgaagcctcttccacgcctccggcgagcctgcactcatccctgtcccagatttcccggcccgcatcatagacctcaccatcatagatattggagaaaaggacaggagacgaaatgcatttccatgtttcatcagtggtaatcatctgccgggtgccgtcaccgaaggtgataagaagctgcgccgtaagcagaaaatcatccccgtatatctctttgacccttgcctcatccagatagctgaaacggcccttgtaccagccgtctcccagcatgacggacagtacgttttctcccggtttcagctgctgtgttacatcataggtctggtattggatccagaaacggtaatcattataaaaaggcgccaggtattcatcgcccgctttttccccgttcaggcatgcttcatagaccccaagccctgatatgtaaagccttgcggaagcgatttgtgacgcctccttctcctccagcctgaatttccggtacattaccggctgtatttcttttccgagaggcgacgttatccagtccgcgttccagctctccccgcagccgccttcgaaccattccacagcgctggttccctggtcgccgtcgtccgcttgcgccgtaacatcccagtaataacgctttccgccttccaattctgtttccgggacaaaggaaagggaggagatatcttccctcatgccgctgtcatacagaagctccgacatgtcttttttttctgctattcggattcgggccgcttttaatgtgcttccgctgctttccgccacctggaaggaaaaggagggattcttaacggaaaatccgagaggattctttaaatgatttacttttaactgattcagtttcatattttcactctcctgttttctcaatatcgttccgtcttcacacatgcagcagggccgtccgtccactgcagcatatgtgaaaatcaatgtatatattgattgtaaccgttggagtgaaaatagtcattgtcttttagactgtctttttatgacctttattgtccacaccagtcctgcgctttatgtcctccggcggccgttttattttcccgctgctgctatccttccgaattatcggcaacaccgttgcccgatatgtcattgcctgactcgccgtttcccgacacactgtccccatgctcctccagatacttttccacagccgggtcttccatatcgtatatccgtttccactctttgctttcctccacttttaccgcttccgaacggtttttatacaggaaacgggaaagctggtagcagtcgatccagatctcattatccgattccttctgtgactcatcaaaaatcaactccaatccccaatggaggtgtactgtcttaatgttattcacattttctttttcagaatatccagtatggcccatataaccgatgatgtccccggccgtcacggcgtcgccctccgcaaggccctccgcataaggataatcctggcgcaggtgggcgtaatagtaataccgctttccgtcaaagctccggatgccgatgcgccagccgccgtactggttccagcccaaaacttccacatatccggattccacagccaccaccggcgtcccgatctggcccatcatatcatggcccaggtggggccttttatagccatagcttctggaggatccgaaatcatcataatcggtatagggaaatcccttggcaatgggcgaataggccttcagcccatatttccgtttccacaccgtatttccggattcatcctgttcctgaagcaggaattcgcccaccataccgcccagcacggcgtcataggcctgataaaaatagtcatagttattcaggtcacaggtgatttcttccatcgtggtttctccgttccggattttttccgtaatggaatccatatccttcagcgcctgcctaccgaattcaccgccgtttttggccgcggtacaggccaggagggatatccagtctatatggaaatcctcaccgtaggtttccacatccgcatcataagcctgacagagggcttcataggaaacattaaaatccacccacttaatataatccttctccgtttcttctcccgcctcttcttccggttcttcaacgataatggaacccgaggttacaggggcagagggtttccctgcctgtctgacggcaaaaagaagggtgagaagcaccagttcaatcacaattgcatattttaacttcccgcagcgtttcatggcggctccagaggtcttttctatccaatatatgcgaaagacagcgccgtaagtccaaggaagcgccgttttttacaacggcgctccggcatattcctcatcaatcaccttccagagacggagtatatcctccatagtccgctccagattttcttcactgcttttccttgcttccgtgaaagggaccggcatcctggtaatgctgaaggcggcactgactccggatccataaatatctcccgtcctctcatcaatgcttcccgccaccacgatcaacggtatcccgtcccgtttggcatactttgccacgcctcccaccacttttcccatcaggctctgataatccagcctgccttctccggtaaaaatgacatctgccccttcgatacgttcctcaaacctcacggtttccagcaccacctctatacccggacataaccgggcatgcagaaaggccgccgcccctccgcccatgcctcctgccgcgcctgctccgggaagttcggatacatctgttcccaaatccgtcagaatctgacgggagaggcagcgcaggcctgcatccagccgatcaaccattgccggatccgcccccttctgcggcccaaaaataaaggcggccccgttggctccgtacaggggattgtcaatatcgcacatggccgtgatgcaggtttgctttaagcgcctgtccaggccggatatatcaatccgctttatattcttcagcgttcctcccaccggcagaaaggcctctccgtcttccccatagaattttgcccccaaagccgccgccatgccgcagccgccgtcatttgtggaacttccgcccaggccaataattatattccggcaaccctgttccagcgcatcggctatcagctcacccactccgtaggtacttgtcaattccggattttccctgccttccgccagaggaagcccggcacaggccgccatttcaatgactgccgttttatctccggtgtccggaattccataaaagctttctatccgttccataaatgggccgcagaccgtcacgctgcgtttctgtcccccaaccgcctgtaaaaagcagtccacagtcccttcaccgccgtcggcaaccggtatctgcacgatctcgcagtccgggaatttattatgtatacatttactcatgatctcgcataccttagcggaggataaggttcctttaaaggaatccggaatcaataccacttttttcatattcgctcctgtcatctgaacaaaggcgtgcaatcctgcccgttaaaagtactttctcagaaatactgcctcagaaatctctttttccctattttccgaataagcttctatgctgactctgccgtcgtatccgccttccttcagcactgcaaagaaatcttcatattccttatggctttctgtcgggaagctccgtccgtcgggatccgcaaaatgaacatgcacaatatcaggtatcctttttttcagagtttccaaaggctccttttccagcataaaatgataataatccgccagaaggcgtatggaaggcccgccggcctccgtcatcagtttttttccttcctccagattctgtataatattgctttcctggcggttgaggggttcaatcgctatatgtatccccgcagaagccgcatagatatcaatcatccggagggcatcggcaatctgtccgaacgctctgtcataaggaaagccttccggcacattcttcgcaccgctgctgccgaatacaatgaccctgcttcccagcttaaccgctctgtctattgctctttttacatattcctgtacttttgcgggatctaccgtttcccctgtcagcctcaccgatgccgggaaaaaattattgcagcattcacagggaaggccggttttttccgcctcctccgccaattctgaaaaactggtttcggaaagctccatgatctgtgccagcggaagctccatgtaatcgtagccggcctcttttaatgtaccgatatatctgcgccccaccgcatcgttcttatctcccagcatattcagacagcatcctaatttcatatcaccgctccttcttctttccggcatttcgccgctgccggggccggaagccctgtctcccgcccccttctgtctgccagtcagcgttttacttcgatattttccttctcttcatagtaacgcagaagggcgctgtgatcgcattttcccatgccctcttcctgaagctttttcatcatggcaagcacctgctccgtcatcggaagctccattcccactgcacgggacgcattttccgcattcgtcagatccttgatatgcagttctatacggaatcccgggtcaaaattgcgatccagcatcatcggcgctttggcatccatcaccgtgctgcccgcaaggcctccccggatagcctgataaacgttctccggattgactcccgacttggctgccagcaccagcgcctccgacaatgcggctatattcacgccaacaataatctgattggcgagctttgtcatgttcccgcttccaatgggccctaccagtactatggacgcacccattttttccagtatcggctttacccggtcaaatacctccggcttgccgccgcacataaaggaaagcgttccgtccacggccttcggttcccctccgctcacaggagcgtcgatcagttccccgcctgcctctgccacttccttttccagttctatggaaacggtgggatcaatggaactcatgtccacgataaccgtcccctgcttcatgccttccagtataccgtcttttccttcgatcactgtttttacctggggagaattaggaagcatggtgaggatagcatcactgcaggccgccgtctcctttgcggttttgtacggcacgccgcccgctgccgccacatccgccacagcgtcctcattaatgtcacagatgttcagttcataacctgccttcagcagatttttagccatgggctttcccatgatgccaagcccgacaaaccctattttcatacatttacccctttccttccgatatggatagctgtctattttcctgccgcttttctgattttcataagaacattgagcgcatccagaccatagtattccagcagttcttcatgggaagacgccgactggccgaattcgtccataaccgccacactctctatgggtactgccgttcctctgaggatatagctgacaagcatgttcagaccgccgcgtatgctggcttcctcacagaccaccacgcccttcttcccttccgcgaaggctttcaccgccttctcactaagcggctttaaggtagggatatgaaccacgtttacactgatcccttccttctccgccatttcagccgccttcagggcttcgtgcgccatgatgccgtgtgtgtaaacggtcacatcgcttcctgcccgaagctccaccggttccccgattttatattctgcgccggcaggaaaaatatcctccaaatcattccggcagagtctgatgtaacaggggccgtcatgcctgactgccgcttcggccgcataccgtacctcaacgccgtcgcagggcgtaaataccgtcatgttcgggatcgcactcataattgcggcgtcatcaatggactgatgcgtcgccccgtcgccgaaatcggacatgccggagctggaacccactattttcacattcaggttagccgtcgcgatgctctgccttatctggtcataggccctccccgatgcgaaaaccgcaaaggtgttggtaaacgggattttccccgccagtgcaagaccgcctgcgaagctggtcatattctgttccgcaattcccatttcaaaatatctgtccgggaacgcctcttcaaacatacagctcatggttgattttcccagatccgcttccagcaccacaatatccggattctccgtccccagctccaccagcatcttaccgtattctattctctggttatgtacccccatatcatgcctccgttctgctgacacagcgtaaatcctgcaaagcttcttcgtactgctcctgtgtgagcgttccgttatggaatcctgccacaccctccgcaaacggaatcccttttccctttacggtatcggcgataatgcagaccggtttttccttcacttcatccgctttatccaaagcctccgcgatctgctgcatatcatgcccgtcaatgaccagcacttcgaatccgaacgcgcgcatcttatcctcaatgctgccaatccggaaccgatccgccgtcctgcccgtcgcctgcagtccattcctgtcaatgatcacccgcaggttatccaattggaaattggatgccgccatgaacgcctcccacagctggccttccgcaagctctccgtctcccaccgccacatatacacgggaatccagcccgtccagcttcagccctgccgccagtcccgccgccagggacacgccctgtccgagagagccggtattggcttcaatccccggaagctttctcatatccggatgcccctgcagccggcttcccagctttttcagggtatgaatatgggcgtccttatcgaaatacccgcattccatcagcgccgcatactgtacaatggcggcatgccctttactgagcaggaaccggtctctgtccttcatccggggctccgatggattatgtttcattttataaaaataaagcacggtaattatatccgccagagaacaggagccgcctaaatgtccggcttttcccactcctatcatcgtaacgatatcttctctgatatccctggcccggttttccagctccagtttcttatcttgatccagcatcgcctgtatccctcccgtttacatttcttccagcatttcgcggactctcagaaagcctgtttccccgctgttgtatacaggaacctttgtatccttaagaaagggtgccagcgcggacatggacagctgcgccatcacgatacagtccacatcctccgacagcttatctatcgcatccaccaggatttcattgtgccgctcaatgtttcccttcgagtattcttcaaaggcttcactgcacaaaagagtttttctttcgatttccgccccggcttctgctgccgctatatctaacagtctttccgaggacggaaccgtggttgccagcgttgccagcaggccgatttttttccctgtgcgcaccgctttttccatcatgggacggtcaatctgcgcaatcggtgtattcacaagcggccttcccagctcggccgcataattaaaggtagagcatgccagaaggatcaaatccacaccggcctcctccagattatgggcatactgggcaaatttgaaataattcactttggggatgacgcctgctccggccttaatgttgtccctctgaatggtatcatcgcacagatgcataatctccacctcagggataaactgcctgatataaggctccatcgcctgaatcgtgatgtgggatgcgtgaatgatacccaatgtttttttgcttaaatccttctttccttccatacccccgcctttccggcctgtgcctttgttcctgaaaggcacgggccaagcaaatatttatgtttcttccttattcgataacgagataagataccccgtgcgccggcatttcaaactgtaattctaggctgccctgtgctgtcaccttctcatcgtcgcacagcttttccagcccgtcccttgccttaatcgccgcatactgttctccctccgggaacagcggacggccctgtttttcccattcggcatagggattggagtgcagggagtcaatacggtaatggctgacattcacttccctgctgcctaccccgtctaccttcaggcagattgtctggtcttcctctttatctctgtcattgcagtggctgtaaaccactatctggatttccccgttcctgccttttaccgcgaagccggacacatccgtatcctctccctctccggtataccggctgtggtttttcaccccgatctccggctcctgcagaaaatccagcttctccgcgccgtcgctctcaaaggccagcttctcgtccccgagggaaccgtagatcttaaacatattgaaaacagccttgtcgattccctgtgtggtaaaggttctggtaccttcaaagcaccgttctcccgggaacataaacgcccaggcgagaggccgcaccttaatgccgtactgtacgctcaaccggtcgattttctcataggtggaggccacataggtcgcataatattccgtatttctgaagatcatattggcattatcatatacccctccggcggcccagccgtccggatccgcttccgacagaaccacctcgcagtcctggtagccgtattcctttatgatatccagccccagcttcacctggtgaaccaggctttccacggaaggaacggccttcgccgcatgcatctcaaacgggaatccgccgccttttacatggaaggtgataaaatcaagccgggtgcctttttcctgcgtacagaaattggcgccgtccctgcagtggcccaggaagaaccggaaaaacttctgcgcatgtccgccctcaaagatacctgttacagccggcccggaaagccgtgcttcaggaagcacctcatgcaccgcatgttcggtataatcaaacaatttacagtattccgccgctgtcccgctccagtaaaaaatatccggctcattccaaagctcaaaataccagcttatcacttcttcccttccgtatttttccgccagatgggaaataaccgctttgataaaagcatgccatttctcataatccttaggggggcaggtccagcctacctccttatactgggcatagttttcccagtctccgcctgacggcttcagataattggtatccaccagagccatgggcataaatcccagttccacaaacggtttattccctgacttgagaaacgcatctataatgtagtcataatatgtaaaatcatagaccgcttccccgttttcatcctcccagtaaatattggtggagccgaatttatacgtcccgtggcagttgcccgtacagaacataaagtgagttctgaaataataaggcgcatcgccgagagccgcaaatttccccagaagctccatgccttccggaatgtaagtatagttgcactcatcgtaaccgataaagcgccacagatgttcctgcacccctccggattcccctgcatcaaccttcacgtttacctgtttactcatccttttttcctccgacacattcgttttttattttcaaatcccctattccgtccaaagagagctcatcggcaaaatgacaagccacaaaatggcccggtcctgtctctttcagggatggacattcctgtttacagagttcctgcgcgtacttgcagcggggatggaaacagcagcccgaaggcagatccgccgcgttccctacctcgcccggcagcatgatacgttcgttcctgaccgtgggatccgccaccggaatggcagacagcagagcctgtgtgtaagggtgcctgggatgatagaataattcctccgtttccgccagctccgccactctgcccaggtacataacgcagactctgtcggatatatgctccactacactcagattatgcgcaatgaacatataagtcaaatcatattcatccttcagatcctgcagcaggttcagtatctgcgcctgtatggaaacatccagcgctgaaacggcttcatccgcaaccacgaatttcggccccagagcaagcgccctggctatcccgattctctgtctctgtcctccgctgaacgcgtgaggatatctgtttaaatgctttatttccagccctaccttatcgaccagatcacgtaccctttcggaaatctcctcctccgggtagcctcccgccagcctcatcggttcggccacaatatcaaaaatggtcatcctcggattcagggacgtataagggttctggaatatcatctggatataccggcgcattcccctcagctgttttttatccagggaagtgaactcaatttccttatcgtcaaaattaaacttaatgcttccttccgttggttcaatgattctcagaatcgtcctgcccagagtcgtttttccgcagcccgattccccaaccactcccagcacctcatttttctgtatctgaagcgtcacatcatccaccgctttcacaaggccaacctgttttttggcaattccggcttcaatcggataatatttcttcagcccagttatctccaacaatgctttcggcatcttttcctccattccgctgtccgggacagcctctattccccctgataatgaaaacatctgaccagatgatccggctccacctcaaccagcggagggatactgcccgcacatgccgctgttttttcctgacaccgggaacagaatccgcattcatcgggcggatcaagcggcaccgggacattcccttctattgcgtgaagtctttcactggacttgtttcccagcaccggcattgatttcagcaggccctttgtgtaagggtgaataggatttttgaaaatagccctggcgctcccgctttccaccacgcgccccagatacatgacggcaatggtatccgccatttccgcaatgactcccatatcatgcgttatgtaaatgatagacatattgaattctttctggaaatgcttcatcagatcggttatctgcgcctgcaccgtcacatccagagccgtggtcggttcgtccgcaatcagtattttaggcttattaaccatggcgatggcgatcatggccctctggcactggcctcccgacatctgatggggataggcattatatttctgctccggatccggcattcccacggcccgaagcatttccatgcacaattccttcgccgcctttttgtcctttttttcctgatgcaccagaactgcttccatcatctgcgcgccgatggtatataccggggaaaggcttgccatcggctcctggaatatcatggatatatccttcccgcgcagctttctcatggctttgctgtcgggtggacaggtcaccagatccaccggcccgctcccgtcatcatacagtatccttccgcccaaaacttttcccgggttctgcaccgtcctgaggatggagtgggcagtcacacttttaccgcagccagattccccgatgataccgatcgtctcatttcttttcagataaaaagtgacgtcatccacagccttcagagtaccggtatccagcttaaagtaggttttcagattttcaacctgcaaaatgtaatcattcatactttttacacccttcctatttgtacggatctgccgcgtccctgagaccatcgcccacaaagttaaatgccaatacggaaatgaccacaaaaataccgggaatcatcatccatggatacatggaaaccgtattgatgctctgcgcatcctgcagaagcactcccaggctcacaataggaggcgtaagcccgatccccagaaagctcagagacgtttccgccagaatcatgctgggtatggccagcgtcacattgacgatcagataactgctgaaggaggggagcagatgtttgactatgatatagccgtccgtcgccccggaaaccctcgccgcggtcacaaaatcctcattgcgcagctccagaagctttcctctcaccactctggccagggtcgtccagccgatcaatgagagaataatcgttatggcgaaatagattttcagggatgaccatgtggtgggaaatgccgccgcaagcgccatccagagcgggatgctcggcatggacatgaggaattcaatgacacgctgtatgatcgtatcggtaacccctccgtaaaaaccggaaattcctccgaataagcagcccagcacaaaggtgaagaatacacccaccaggccggtgctcagggaaatccggagcgcgctcagcacgcgggaatacaggtcacggccggaagcatccgtcccgaagggaaaatatacatccggctcaggcgttccgaaaaagtgaatatctccgggaataaacccaagcagcttgtaggaatcccccttgtaaaagaaacgcagcttatgcttgactgtcgtatcctccacataatattttttccaggtcacgggatcctcttcctgcttcaggccataaacaaaaggctgtatggaaaaattcccttccgcatccacaaaatgtatctgcgtgggcgccatactgatagccagcgtactccttttggctatatcctgggtggcaaaaaattcgctgaaaatacctaccgtatataaaagtattaatataatccctcccagcatcgccagcttgtgtttcctgaatttccgccacattaactgccactgtgtttccatataaatttcttcctctttggaaacatccgtattttttttcttaatcacggccatatgtcctcctttcctgtaaccttcacatttactgcagacgtattctcggatccactaccaccaatagaatatcggagataaatgtgcccacaatggtgattgccgtaagcatcaatacactcgtacccgccagatacatgtcctgggagagcagtgcattgtacaacagggaaccaaccgtgggaatatccaggacaatagccgtcaccgttgcgccggatacgattgaaggaagaatactgccgatggagctgattataggattgagcgccacccttacaggatatttatatatcattttattttctttcagtcctctcgcccgggccgccactacataaggccttttcaactcatccagaagcgtggctctcaggatacggatcacattggccatgcttgccaggccgataacgattaccggaatgggaaggtgcttgcacaaatcccatagccgtgcaaagctccatggcgcattttgaaattccggcgaataaaagccgcctacgctcagtccgaaatacctgttgctgtaatacataagaatcagcgccaggaaaaagctgggtgtcgccaggccgataaatcccagtatggacgccagatagtccccgatggaatactggtgccttgccgaataaatacctatcgggatggcgagcgcataagcgaaaaccagcgttatcacggaaagcgcgatcgtcatcggcatacgggtcgctatcagtgtgcccaccggctgcttccactgaaatgactggccgaaatcccccttcagcatgtttcccatccagagaaaatactgctgccacataggtttatccaggccatactgctggcgcaggctgaggattacggaatcatccacctgtcccatctgctgctgcagattagcaatatatgatgtcagataatcacctggcggcaattgaataaccacaaacgcaaacactgacataaccgccagcaaaacgatcatatagataaatcttttacatatatatttcttcatttatctttgacctctccttcttcccctccgggcagcaaaccggtcccggtatataaaccgcctgacggggaggcacatgtctgtacctccccgccatttaccaaacatatgtctgtctcatatgttctgcagctgtgatactttctgtctgaattattccgttctattcacttaatatttgaaataccatgtatctccgcggtaaggcttccagaagttataatcgttggcaaaggttccttccgtgggagtgttgcccagacgattgctgatgataacgagacgcggtgaaaccgatacgccaatgaaccagcactggtcactgattctcttcagaatactttctcccagcgcagcatattccggatccgtattggacatagttccgaatttcaggcagtcatcgtagatttcctgtatttccgccggaggctgttctcccttggctccgttgctgtcccaataatccttatatgctctcatgaattccagatcgtcataggcattccccggacgaagccggctgaaagcagcgcctctcaggttaaattcacccacgctgtccatggtgaacgcctgcatgtcacgttcattcccgactcctctttccagataataggaacgctccacctgcttcagggtaaccttgacacccaccgcattccaatactcacatgccatttccgccatgggtacaaattcctcaatcgtttccaaaacaatattgaaatcctgcccgttgggcattgtccttaccgtatgtgccgaattccattcatatccacattcatccagcagtgcattggctttatccacatcatattcaataaatgcattttcaaattcctccttcatgaaggaaacatctgccgatgccgttgcctgtctcaccgtgccttttccgtaatacagcgtttcattgattgtattcctgtccagcgcatagctcatagcctgacggaattttacgtttgtaaaaatctctcttaaatccggatttttatccgtgatattgaaagtaaacgcacagtcggagcctctcgtattttcaaacagaaatacctgataatcgccgttggcttcgttctccttcagcatggtataatcggaaaccggaagcgggttttcacctgccgcatggatttccccgctgataagcttcagggcgcgtacatccttatcctgcacaatcatcgcttcctgttcatcaatatacggaagctgattgccctcctgatccactacatgataataaggattgcgtgcaaaaaatttatttccgttcgtatctatcctgtcgagaacccagggataaacatccggcgcgtcacagtctgtctgtgcctgggaattgtccagatgagccttaaagcagagaatccaggattcatagccttcctcctttgccagcttatccgcatccgggttatatgttttatgccactgcttcagatattccttgggtgcaaaaaacgtccggattatatttgtggcataacgggccatcgtgatttcaaatgccggattcggctcctcaaaaacgatatccagggtataaggatctatctgctcataaaccatgggtttgccgttgctgcagtaggctgcttccacagaagggttaacatcggtattggtgagaatatccgtataccagaacatccagtcatccgtagtcaggtcgtcgccgtttgaccacttcatcccttctctcaaatgaatcgtaaaccgggtggaatcctcattaatttcatatgactgaatcagattgggcttaaatgtctttaaatccttttcaatggtcagaagtgactggaagcgcaggccctctgtatcaacctgtccggagctggggccgaatgccgctcccacataggttcctccatatgcgccgatttcatcaacctccaccaccgccggttccttgggaagacgctcttcaatcggaggaagctctcccttttccacctgctcatgcaccagcggagattctttatactgcccgtctccaacgcctcccctgacgagattatccggcgccggcgtttccgttcctgccgtctgtgtgctctctgcagtctgctgctctcccgaaggcggcgccgctgccggagcctggcccccgcagccgatgctccccgccgcaagacagacggacatcaacaataccatcatctttctttttttcattctcctacctctcttttctactttttttaacgaaagccgaagcttttgcatcatcagttaccttcccgaaaaaggattatcttgttttatcagtgtatccctggttattaatatgggctgcagaatgacccgcttatgaaatttctgctcatccataacattattttcttccctgcttcccatcctgctctccgcagcatccatcaatgaaaaacattctgcaatcatcatgttcgcatccagggaataagtggtcagcgcaggtgcaaattggcttgccagcgggatattatccacactgagcaccgaaacctgatccgggacttctatccccttcgtcctcagcgcctgaatcaggccgattgccatccagtcgtttgccgcaaatacggctgtgaatttccgaatcataatgagattggatatctggtccgcgagtgcatagcctcctctgaaattcatcttgctttccagaatcacgtaatcgatcccgtttttcctcgagccccggataaagccgttcttccggtaaagtgccgaggcgtatgtatccggcccggtaatatgtaccacctttttatgtccgtaaccggccaggaccttagccgcgttgatgccgattttgaaatggtcaaaataaatctgggcgaaatcatcatggtccggataattttcaaaggaaataatgtgcggatatatcttctttatcctctgcaggctgtcttcttcgaatttgccaatcatcaataccggtgaaatcatatccccattttccagagtatccaatgtcagcggaatcatattcacactgttcttggctgaatagctggtgagttccatcagcatcctgttatagaaagggtcattcagcttgatgctcggtgagcagatgagattgacatatttgtttttaacaataggcgcaatatatgttcccttgccctcatacttgataaggatcccttctgaaacaagctggtttattacttcccggatcctctgccgtcctaccatcagcctctgttccagctttctttcagactccagttttatcaatcggtctgactgaagctgtttgacttcttttcgaagaatatctgcaatttctttattttcccgattcataatttcttctcccgcttcaatcagatacattatttttggttattttgcacaatgccattttcaaatttgatatatgcttttttcacaaaaatcgcttttggtttaacccaaacaagagtataatttgtaattattgcataatttttaaacccataaatgttttttagtatgtctattaataatttacaaaccaatttattcatcatttttactaataatatatcacgattattctgctgtcaatagcttctctcattttcctttcttttcgtcgttattttagttattttatacttatttggagcatcatttttatgcattttcacaatcatattttaatcttatttgttcaggcgatatgccatttgtcacatttcacctttcccaacagcagaagacaaaaaagcagcaggtaatcttcctgccgccgcaaaaacacttgattcatttattaaaatatggtttaaaaaaagccccacaagcttaatgctcatgaggctttcctgtcttttatacacttatatggcctaacctttaatattcaggttcaatcaaaccataagtatttccttttctcttatataccacgttgacctgatctgtttccgcattgaagaaaacaaagaagttatgtcccagcagctccatctggatgcatgcatcttcgggatacatcggcttgatgtcaaacttcttggttctgacaatctgcacttcctcttcctcgggataatccttctcgataaaagcctgctggaaattgccgccggactgatgcttgtccatgattttattcttatatttcttaagctgtctctcaattacctcttcaaccaggtcaatggacacgtacatatcgttgcttgtctgttccgacctgataatactgccttttaccgggattgttacctctatcttctgtctgtctttttcaacgctcagcgttacgagtacttctgtttcctgggtgaagtacttctccagctttccgatcttcgattccacggcgctgcgaagcccctgcgttatttcgatgttctttccgctgataatgaatttcatgctgatcatcatcccttctgtttcatattaggcacaaaggcaataccgcctgtcgcgtcctgtagcatgtccttttgtccttaaatggattataccatatccccacacccgcatgcaatgttttcagaattttaactgaaaatttatatttgtttcagtcaatgcaaaacgacatatttttgtaattattctgtaaaattcgtggaacttaccagaacattcgtttcaatatacgttctcccgcacagctgtgaaatactttcccaaactgtggataatgtgcataacttcgtgtataactcccaaaccctcataaataccgccttttttatgtggatatctttgtggttaaaaaattcccttttcgacaaaaaacctcagattttgtgcagattttacaaaccgcttaaaatcagcacattttcagataactcataaagtgtctgacaattagctgattttatcagtctttagagatatcgaagtatgacgtataatggctccgcacatgggatcggcgcccattcgtgggataattccggccgatacgttcccggcattttcgcggaaacacatgccgccgggagtactaaaaaacgggatatgaattcacattcatatcccgtcctgaatattctgattattactggataactcttcttacagcaaccggagttctgtaatcagcatccgaaatcttgattccggtgctcgctgtactcgcgtgtacaatctgtccgtctccgatatagattccaacatgtccgctgtagcatacaagatcgccgggctgtgcattttcaagtccgcccacatccacacctacatttctgtctgctgtggaggaatgaggaagagatacgccaaagttctcatatacgctcataacaaatccggagcagtcagcgccgtttgtaaggcttgtcccgccatatacatacggattgccaacaaactgaaccgcatagtcaactactgcattgccgcttccatgattggataccgatgctgctgaggaaggcgtttccgccgcctgggtggaagactctttagaactttcctgggtggctgcagtttccactgctgtggaagactccatgcctgccggactttctgtctcagtggcagtctctgttgctgtttccgttgttgtctcggtcgttgtttctgtagcagtctcggatgttgtttcagaagaagtctctgtcgtggtctcggaggctgtttccgatttggtttccgaagaagtctcggaagctgtttcctttgagctttccgtagaagattctgattccttcttggactctgtttccttttcggattccttttcctgcttattatcatcggcctgaactgtttcttcctgtgcaggcttctcttctgtttctgtcttagctgtctgtgtttccttcaaattaatcggctctacaatcgttttgggcaattctgccgcttctccaacagcaaacgtatctgtcggcacaacagcctgtccgcctgatgcggtattatcaccggccgccgtattagaagaagaaactatcggttccggattcactacggcatccagaacactggctactccaaccccattggcgattgcaacttctgtctgctgctcctgaatgtggctgtcaacctgagcgtcaattgaagattctcccactccggtaattcccgattccatatcagcagaagtcaaatctgaagattcctgtgcagcctgaacggtctgttcagccttttcactttgatccgccgcttcctgtacacttccaagggaactgccttcatccagagcaaggccaacaccagctgccgggagttcataagatacaccggatgcacttgtctgcattgctgctgtactgaataacattgccgatgcagtcagtgcacatgtcactgctttcacgcgtgtatatttcatgagttcctccaaaatatcaattgaactgttacatttgttacgaaattattacatctgttgttaactataccaccgaaggctttctttgtcaacctttacacaaaaaacgactttaaaaggaaaatccctttaaaaccgcataaaatcaggaaaagaagggtttaaacccttcttttcaaattgtgaacattttttgaatttttgaaatattcgtatcaattatggaataaattaacaaaaataaatattacgtaacatttaatatttaaaatgtaataaaaaatgcatatggtctgcaggaagtattcctacaggaagtattcctacaggaagtattcctgtatgccctcaactgcattggctccgtccgctactgcggttacaatctggcgcagcttcttcgtccggatatccccggccgcgaatactccaggcatacttgttgcacagtcctccccggctatcagatagcccttctcatccgccgctatattagtaataaagctttcggaattaggcttgattcccacggctatgaaaacaccctgtaccgcaagttcacttttggttcctccatttttatgaaccagggtaattgaattaacacgtccctctccattgatgctttccacaacgctgttccagcacacctcaacattaggaagggcaagcatggtatcctgaagggactgcgccgcccgcaggctgtcccggcgatggatcagatacaccttttcgcaggctcttgccaggaaaatggcatcctctaccgcaacatccccgccgccaatcacggcaaccgtctttccccggaaaaaagctccgtcacaggtcgcacaataggaaactcccataccgcttaattcctcttccccgggcacacccagatggctgtgggaagcgccggaagctatgatgaccgcttttgcctcatagtcgccatccgttgttttcaccagcttataatctcccatatcctcaacacccaggacatcggcttctataaattccgcctgcattttctccgcatgctccctgaatttcatccccatatcaaaaccattgattccgggaagccccagataattgtccacttcataggtgttgagcacctggccgccgctcatgggattcttttctattactaatgtagaaaatccggcccgtcttccgtataccgcagcgctgagccctgccggtcccgaaccgataataatcaaatcatgcatactttttacccctttactctataatacttagctgttgttttatatatatcctgtttccgctcttcttattataccggtttccgactcagctttcaacctgcatacatatatgttataataggaaaaattaaggaatggaggactggttatgggaaaaaaagcgttggtgaccggcgctgcccggggaatcggaagggctgttgctgaggaactggcagggcagggatttgatctgctgcttacctgtctgcattctatagatgaattaaatgcattttgtctgtatctggaggagaaatatgatattgcctgtacctcttttcagggagatatgggagattatgaaacagtgaacaggctttttgaatctgtctccggactggatgtgctggttaataatgcgggaatttcttatatcggccttttatccgacatgtcggctgaagaatggcggcgggttatggccactaatctggacagctgtttttatacgtgccggaatgccatacctcttatggtgcatgccaaacaggggcggattattaatatctcatctgtatggggacaggcaggggcatccatggaaacggcctactccgcatcaaagggggcggtgaacagctttaccagggctttggccaaggaactggctcccagtaatatacaggtaaatgctgtagcctgcggggttattgacaccgatatgaaccggtgttttgcaaaagaggaaatggatgctctcattgaagaaattcctgccgaccgcataggtaccccagaagaagttgcttcccttgtgggacagcttgtaaatgcaccggcatatatgacaggacagatcattacaattgacggcggatggctttgacgcagaccatccgctgttttttttgaatgaataattgtcagatttacgagggcagatgtccggttccttgagaattcggtatgcattcttttttcagggtttcccatataccgataagataaacagctcccagcgccctgtcatacaggccgtagccgggttttccttcttcattccagatcatccttccatgagcggggctcatatagcctgtatatccaatatcataataggccttcatgacagcctccatatccagcgaaccgcagaaggaagggtaggcgctttcctcaaaggagccatcctgaaggattttgacattacgcatgggggcataatgaatcctgcccataccacctattttcctgaccaaccgggggatgtcattgcatgctgcgcatcccaggctgccggtgcacagactcaggccatgatgtgtgtcattatacagcgcgaggaatctgtctattgcagcttcgtcggtaataatcctggggatgtcgaaaaccggccacggcggatcgtccggctgcaggcacatatttacatcgcactcgatggctaccggcatgatttcattgataaagtactttaagcttccccaaagtccctctatgcccagtatttgataagcctttatcagtccgtctatttcttccgggaaataggaagtattccagcccggcagaatcattttagcaggatccatcgttttttcatccgttttataataggccagggttctggagccgtcggctaaggggtgatccaggcgggaacgggtccagtcaaataccggcataaagttatagcagatacatcggattccttctgcagccagtcttctgatattttccttgtaattttcgatatattcctggaattttcctctgtgcagcttgatatcctcatggaccgggaggctttcgatcacttccagtaccagccccgctgctgtcactttttctttcagttcctttatggcctcacagggccatgcttttccaacagggatatgataaatggcggaagcgattccggtcacacccgggatctgcctgattgcagagagcgtcaccggatcctcttctccataccatcggaacgtcattttcataaagactgctcctttctgagccgtcccttcctatataaagtaaaagcccagcggcagatgccaaggtcaggcaagcggtgaatcgaaggttcacctggttttggctcgctgcctgtgggaataaatacaggcggactttaggcagtttcatcttctgcttttattctttcccggagttttatttttatgaaaaagagcgggcgaaaggaattggaaattttttataataaatcagtccatactgttccgccatctgccggaaacgggtatccaaatcttcggaaaagccggtatgacgcaggccaaaaaaggcatactgtgtgtatgcctcaagatcacctctttattccgttatgcttattctgccaaaacccggcacagcttcttataaaaggatatgccataatacagaaatgtgtggtacccttccagcttcagttctgcgtcatactgcttttcttttatctgacacaacgcctcccgggcactgccgtctaactgcgcaaaggaatctgcagcctttagctccataattaccgcaatcccttcgtagggcgccgacagcaggagaaggtcgctcctgcccaggccactttcacggtttgactttaatgtatagccatccatcattttcagcaggccggccaggaacccatggtaataatcctccttatagtcatagaagctgatcgtctccatcaggctttttgatatttcccgtcccatcacgtcggtttccccctgcatcagcccccggtacaaggcagaaaagtcttttttctttatgctctggttgaaccaatctaagattgtatcccggtaaatcagctttacctccgtgtttggtattgcaagtgtcagatatattgtttccccgtcaaacctttcagacagcttttttaaatacccggtaaaaaacaggaaattccaaagattatcctgagttttataaacctcattataggtaatgtccacatgcaccggtttttctatgctcccccccgcaatcagttcttccatttcctgctttacgctgccatccgctcgttctaccagttcccggacgatgctgttggatgaagtattcgcccagtatggcatcgggaatgccccctggtcttctgacacctcatccacataatttatgacactccagggattatatacctcagtgtttccaaaaaggtacccatcataccattgttttacttcctcgcttttgcccccaatcccatagtcacagagcaggctttccacctctttttgggtaaaaccgaaatattccccataatttttattcattattgagattatttgcaggttattcaaccctgtaaatatactttcctttgtaatccgaaggcatccggtaataactgcaaactccagattcgggttcgttttcagcgccgattcaaacagcgaacggatgaaatctgccattttctcataaaatcccttaaaatacgcattctccagcggcacatcgtactcatccaggaggatgattacatttttacggaatacttttttcaggcagcgtgtgagaaattccagcgccgtggcatactctattcgggatgcctgcttccctcttatacggatatactgatctttttcttccggtaacaaaatatccccacttattacgtagttatgccggtcaaactctttggatatttcattcaccaccgcatcaaaggccatatcaaaatccggctgttttgcagacttcaaggaaaggctgataacagggtactggcataggcgcctggtataattctccccggcatccatgattttcaatcctttgaacaagctgctgttatcgactttacatccatccggatcatatcctgcctcaaaaaaatatctgagcatactaagcgccagggtttttccaaacctccgcggccgggtaaaaagttttacttcgctactcttatccagtatctctttaataaaaagtgttttatctatataataataattgttctctctgatttttttaaaatcatcaatccctataggcagcggcttatacattagctcccctccctttctctggttagattataccccgtttatgccttatctgcaatatttttcccttctggccggtttcccagtagcaggacaggcatatgtccaccatatcgcttgtcatcaatctctcatttctttgtttcatcatataaccattctttataattatcggttctcttctattttttcataaacaaaaaaccctcaagagaacataattttatgctcccttgagggtttttctgaatcacacatattaaataaatcctaccgtacctgcttcatacatacaaaagtaaccggcctcccatacgaaaccgcccgccgttctccatatcgtacaaatcccgcacgttcataagtctttatcgctctccggttaaaatcagctgccagcattaccacagttcctctctcataatgataaaagctgcgtgcataggatatcccggcattcacaaacttaagtcccataccttttcctgtctcctccggccgcatacccagaccgatttccatcactttctctccctgttcctcatgaaaactgaattcatagaagcctttcagcatcccgctgtcatcggcaaccgcaaaccagttatcaatggcacctttgatttcctccatacactcctgtctgtttttttccggtatgttatagaaatcatagggagcggaataattccagccaagatactctgcggcatactcttctgtcataggaacaatatgccagccggaggcagtcggaacagatttctcttcctgcttttctttttttgctctcccgtctatcagcttcagtgaccgagttgcctcggctcccagcaaatccgttcttccggcatattctttcaacacccggattccttccggaacaggaaaagcagaaaggcagagcaatgctttccattggataatctcatcgctttcctttttcagaagacggataaccctgtcagcatttttttcagaaaccagggacggatgataaaaggccataaagccaaccgcatccagagcctccgaaattttccatctatccccggtatccaggacatcaaggagcagagggaaaacagcaatgtccattcctgccagcgtccgggctatcagatctctcggcagaggatacgattttttggcggataccttatccggcaggcttctgtgctgatttttccccaccctgcccagatagggaatcatcttttcagccgcagccctgccgcccttttccaggctttcacagacagcgattcttgtataaagacacgtttcccggcacagctgttccagaagcagttccgccacgccttcggtttccggatgcagacaatatgctgccgccgttctccggcagggatcgggattgtgcagttcctttgccagttcttctgccggcaggcccgcacaggctgcaatttcttctttggaagcctttccccggcttctcaattcggtttgtgtacttttcactccgctcctccctctatttctttttatagcatattacaaatataatcactgaggccgcagcggtcaaggcttccgccgcaggaaatgccgtccagataccgatgacaccggcaatccttatccccagatatgccgcaggaacaatcagcgcaagataacgcagcaaagatataaggaaagaggcaaagcctttccccaacgcctccagagcaccggaacagaccacgctcacaccggagaccacaaagccaaagcttataatccgcagggccaaagccccttctctgacagtaacggcatccacagtgaacattttcataatggagccggaaaatacaaggaacagcagcatcctcacagccataatcgccagtatcatcgcgccgcatatctgaatgatccgtttcatacgttttctctcatcagcgccgtagttatagctgagaatcggccgcattccctgtacgataccatttgcaggaagataaataaaggactgcagcttaaaatacacacccagaatcagaatataaataggggaaaacgctgctgcaaaaccattcagtatggtgatcagcagggacggaagccccatggtcatggaacaaggcacacccaccatatacaccctgcggcagatatccgcagtaggtttcatataagtctttttgattgataatcccatatctttcttaaaataccaaatcagatacagcagaagcgtaaccacctgcccgatagccgttgcgattgcggctcctttcacctccagccggggaaccggtcccagaccgaaaatgaacacaggatccagtataatattagtaatgcttcctgccgccatgcagaccatgggaacaaacatatttccggttgactggtatatcttttcaaaagcgatctgcaccgttaccactacggaaaagctcagtacgatgaccgcatattcctttccccacgcaagaatcagattgtctgcggtgaacatgggcagaaaatacggaatacagataaccgtacctacagaaagaagtatcccatgaaccagactcagaaaaagcccctgagacgccgccctgtcagccttctccttttcacccgctcccataaaaaaagcgactgccgcgttgattcccactccgaatcccaccccgatggaaacgatgagtgtctgcagcggataaacaagagaaaccgcagtaagtgcctgctctcccagcctggcaacaaacatgctgtccacaatattatagagggaattaataagcatggacagcatcattggcagcgccatagaaagcacaagcggcaaaataggttttgttctcataaaatcctggttcatattcttctatctccttttacacaaaaaaaactataaatctcactgtttgattcagaaacagaaaaatttatagtctcgtatcggacgctttattattacagccaatataggctatcataccctgtgtaaaaacgcaagtatatttttctatgccataccccaattttcaacccatactttcaatctcactaaattccatacctcaaaagctatccctgcacggcgcttcgttaccattctctctccaattaccagctgtatcctgcttcactgtttggcaggcttaccagcttctgtcctgtattcccttggcgtcacgccgaattccttacgaaacagcttattgaagtaagatatattatggaaaccattttccatagccgcctccatcaccggctgatcagactgcgccagggctgccgccaccctggaaaggcggtaatgattaatatattccacacaggtcatccctgcaaatttcttaaaaaaactcatgaaatgagcctgactgaaatggcagacaccagccagttcctcaatgctcatagtctccgtataatgttcccggatataactcaacaccgttttcagcttacgttccaactcagaatccgtggcggagccttcattctttaccacatatccatattgatacaaaagccggaaaaaacggaataagagttccttcatatataactcattcccctcccggcgccttacgccctccggcatttcccactccggccgcggagaatgattcttatcctccacacatgtaagcatttccctgaaacactgcagcagttccccatgccccggacaaccggcccggattataggaacaaaacggtacttccctttcaaaagcggactgatatatttgatagtacaggcatccggagtctgataccccagcatatcaagatgaaataccagactctccgatatcatctcctctttcttcagcgcatgagccgaatgcagcgtatgaggggatataagcaggagatcatcttttctcacccgatagttttcaaaattaataccataatcaatactccccccttcaatccatgtgaactccacctcatcatgccagtgaagggacaaatcctgataagaaaagggtactatacaccgataacgctgaataggcatcagcacatccccatgagaggctttttccttataatcagaaatccccgtatccttcatatcctctccctcccttcctttttctttttttattataaacatacacctgccgcccagtcaatccactccattcccagcgccgctacacaacacaataccccagccgtccgcccattggttcgtcctgccaaggccattgcctgccgcccggccccatgtccctgcgcctccggccccccgtatgtgggatccctgccctgccggctccggtccgccttggggctatgatgtcccgcagatactttctataccatggagaggagaccaatcaaaatcggcagcccatctgccgattttgatgctttgggctcatcggaatgcccggtatagcagtatctgcaggacatcatagccccaaggcggaccggagccggcagggcagggatcccacatacggggggccggaggcgcagggacatggggccgggcggcagacaatggccatcggcaggacgaaccaatgggcggacggcgcccttcacgcaaaaaaaacagaggagaatctcttctcccctgcttcccaagtacgatataaatattctaatggccgaacccaaaacatgatggtactacggacgacagaatacttctttttcttctgcttatgctgcgcagacgtttaccgctctcagttttctgctgtctctgggatcactttccatttcgaaagtaaccttctggccttcgttcaggctcttgtagccttcagaaacgatggaagaatagtgtacgaacacatcctcaccgcttgcgtcattagtaataaatccatatcctttttctgcgttgaaccatttcactgtaccgttattcattttcagtacctccattataatatttatatcaatctaaatcagcaggaaaaccactgatgcctgatttccagaaatacctgcggcattttccttacaaaaaaagcggccccgttatcagtcattaagaaaaaaggaatgactcataactaaggccagctctaaattcaaattgattactatctgactatatcatgcatttgataaattgtcaaacattttttatttttttgatataaaataattttgggggacggcttctgctcctctgtacatccctgccccctgccaatcacgcatctttttctttttcaaaaacagcatcaaatacggaatcccttgctttttccaccgtaatgttaaaaacgatggcaaattcggaaatcaacattttttccgctctctgcagattcttttcatcggagcaattcagttttttcccatttttcttttttctgtcctgttccagaagaatcgctttcatcagcttcaggtactggcttacttcacaggatttaaggatctgtctgcttaatctttcacgttccttattgttcgcttcatactctgcggtcatttcgggaagctgttccagatattctttcgcttccttcctggacattacaggccgcatgtatactttgtcattattcagcttaacatatatggtactttcatcattcccaacggaacgcaaagtataatatgtctccggcccattcacaaaatcaggctttccaatcgctgcaatcctgtacacaccaccgttttcatgcactacaacatcatttacattatacattttacacctattcctttacaactgaaaaaactgcgccggtaacacaggtcagttaccgacgcagcagttatagattcattatagcacactttcaggtaaaaaacacctgtttctcgaaaacaggcaaaaactgttatttttcgttgatttttactgttaaacggtttcatcccgtaccgcatctgcgatcgattctttatggatactcataaaggccagaagataggcaatacccactgccgccatcaccagtcccatattggcaagcaccttgagccagggaaatgccggaagcaaagctgcggcagcaattcccgtaatccgcatgaaaaatatgcagagcaagaaaattatgggaatccctgtaagaatcggggccgccgccatccgcaggccttccagcaaaagcatttttttcagctgtccttcatccatgccaacggatcgcagtactgcaaattcccttcttctcaggcgcagggaacccacagccgcagaaagcgcgttggaaattcctatcagggaaagcagtcctcccgtcagattaatcaccgcttccatggcccttccggcgactgcgctgtccctctcttcttccatccggcttcgtatcaggaaatcctcttccgccagatatccgccgctgatttcccggatttgttctgctgtggaaagatcctcctccggcgcggtcaatgccagtcctctgatttggtaatattccgcggcccgttccggcaaaaacccggatactatatactgatatactcccataggcacatacagctggatgctgtaatcatccgcataataatccaaaaccggtctttgggacgcttttgttcccacgataacggaaaaacggtaatccgtgttatcagaatcccgcagcctttcttccagagtaagcgccgttccggcctccagattaagcatctgatattcctgaccgtgtttttccgggttatttaatacattcggataataagaaacattgcttaccatgattgcccggggtgtgtcctgtccatagtaatcggcaggattttctcccagtgaacggcagtattccttaaaaaaagaatcctccagccctatgatattcgcccgtatccgatagcttccttcccgttccaggacactgaaccggttgggatccaccgccccgaaaccgcccttttccgtaaattcttcggattgtgcacccgcatccagccacagggatgttttcgtcctgtaataccaggttccttccttaatagcaggaatctgaaagatctgttccatcatttctttttccggctgtgaagtcagactataccgcatctgaatattataatgattcgtgctttcattccgctttgtcaccaaatcattcacagtaatcatgcaaaagaaaccggaaatcatcacaaagcacatggtaagcgccgcaagtcccgcccggaaagcctttttatgtgccttttgggatgccgcccccaaaattccctctattccgaaatgagagccggtcatggaatgccgcttccttaacacagggaattggcttttctttctgcgctttttcccggctgcatccgtctgcattcgtatggcatccaccggagtgagcctggccatcctggaagccggtatggcagcggacaccaatacggcagccagagagatgaataccgctcccagaataatcccgggcgggaaccgcagatgcatgggaaaataaagcaaatcccccaatattcccgtataaacccgcatgaccagaacagaaaacaggcagcccagcataattcctgcagctatgggaagaatcgacaccgcaataccttcaaacaaaacggaagcccttatctgcccgggtgaggccccaacggatcgaaacaggccaagctgctttatccggcttcccgccgacatggcaaaagcgctgtggataatcaaaacaaaggccgccgccacaagaactaccaaggctgcatacaaaaacagggcgctataacgctccagcatatctgcggaaaaaccctccgcaggcggaaacacaaaatacagggataacagccgtccatgatagcggaaatgattttcataacttccatattcattggtttcaaagcccagctgttccatgagctgaggcataacccggtatgtctcttttatccggtttacctgtacataaactaccagttcatccgccgggtccagttcatcccggtccaaataacccatggcataatagcccggagtggttgtttgagtcgtcagatccagtttgcccactatggtgaagtttttttctcctgtttcagaaaacagttcgccttcctgccggattcctgcatccgttatttccccctgaaccattcgatgcccaaccggcagtgtcaggctgtctcccagaacaaacctgggattgctgtcaaaaaaagatttggataccgctatctctcccggctttgcgggtactctcccctccgttatcacatttttttctgccatacattcccagtaatctttatccgcatctctgagcatcagataaggaagcctgctttcttccggcagctttacggtaaggaaagggccttttaccatcgtgcggcgtatattcagattgctgtcaatctgttccaggccctcctttgtaatgtatccccccacctctgcatgccagtctccgccttcatagatttcaacgtcccgctgccaggcgatctgattataaaaaagactgcaaagggaacaaagaagggtggatgcaataagaaccgccatcatggaggcaagtgtggtcctcttgttatttttcatacttctgagggtatataaaatcaaaaccttcattataccctccaatccccgccgctctgcctgctgtcctgcagaatgcggccgtcctcaatggtgataacgcgatcggcctccagcgcaatcctttcatcatgggtgatgagcactatggtctgatggtaacgcttattggaaagcttcagcagcgccagaatttcctccgaattctttctatccagatttccggtaggctcgtcggccagaaggacggccggccggtaaataagcgcccttccgatagcggcccgctgctgctgccctccggaaagctggctcggaagatgggacagtctgtcactgaggcctaaggtatccgatagttcccggaagctttcctcctccggtttctgtccgtccagcaaaagcggcagaagaatattctgttttacatccagcgtgggaatcagattataaaactgataaataagccccactttacgccttctgaaaacagaaagctgtttttccgataaggttgaaatatccgtatcctctatccatattttcccggaggtaggccgatccactcctcccagcatatggagcagagttgattttcccgatccggatgcccccacaataacggtaaattcccccttctctatcgccagattcaaaccgtccagtgcttttacctctgactgacccagctgataggttttcgtcacgttttcacatcgcagaatgttcatgatttcctcctttccagacggctttgtgctgcctgttcactccgcattgtaaagggcttatgtgacaatccggtgacattcagtttccttttgcataaaaagtcatgacaaacctggccccgccttcctttctgttttccgcacgaagctccccgttctggttctccgtcagtgattttgccagcgccagccccactcccgcgctgtgccggtcctggctttttcccttgtaaaaccggtcaaatatatgtctgcattcttccggatcaaggcccggtccttcgtcttctatgagaatgcgggtataaatggcattctgctccgcccggattcgtatacatccgccttccggcgtgtgttcactgcagtttttcagaatattgcctatcgcctcacctgtccatcccaaatcacagcacagccgctttccttcctccccttgtatgcgcactgcctgtctcttatattctgtaaaagaacggaccgattccactgcggctgaaagcacttcctgcagatcctcttcttttttctccagcggaaggactcctgcatccagcctggacagagtgagaagggctgaagtcaggatccggatatggtcggtctgctgttccatcctgacgagcagctgtctcccatcttcgtcttttacctgttcctccagcaattcctgaagcagggaaacagaggtaagaggtgttttcagctgatgggatatatcagtcaggctctccgccagattcttcctccctcttttcgcttcctcacgactttctctcatagtaatcatggttttatagatttcatcctgcagccttgaatattcatcctcccggttaccgatacccgtatcatatatcccgttgtttattcgtatcatataatcggccagttcctgtatccgccgtctgtgcctcctgttttccatggcataccagagcgctccccctcctgccagcagcagaaaaaaaagaagcaggatacccagcagaccggcagaatccgcccgcgtaaacaaccctgcttcataaccatactgcttcaaaagggcctctcctttttccactttctccggctgctcccgtttcagggaacgcatcatttcccccgccttttccggtgcacaggccgccatgacagccgctcttttataaaaagaagcctcactccgcctgacagccagcaatcccgttcccaggcagaccagcatgcagatgaaaagccacaggaccagaaacgcagtctttttttggttatgcttcatttccatcctccgccttataaccgattcctctcactgtttttatcattctctggggatcaccgcccagcttctcccgcagccgttttatcaggaccgtcagcgtattgctgttcacaaaatctccgtcaatatcccacagcttctgaaggagaagggtgcgtgtcagggtacggttcttattttccagaaggatttccagaagtctgtactccccggctgtcagaaggatttcttttcctcccgcctgtaccctggtttcctttttatccaggatcacatccccgcatacaagccgctctgctgctgcctcctgccccttttcatcgggctgtgagcggcgcagggccgcccggatcctggaaagcaatacccccagcttaaaaggttttgtcacataatcatccgcccccatatccaggcccctgattatatcagcttccccatcccttgcggtaagtatgatcacaggagggccctccgcctctctgcattccctgaggaagcacagaccttcgccgtccggcaggcccagatcaagtacaattaaatcaggattttctcccgcaagtttttccgccccggcaaggctgccggcagccagtatttcatatccctccctgaaaagagcggaacgcagggcaaaaagtatggtttcatcatcctctacaagtaatatccggctcattttcatcttttctcctttttagcttttctgaaacctctccctctttcctcactttcctgaaagcatatccatcatctcttccaattccggcaaatgatcttccagattttcttcaccgatataataggccataagcacctgattatcctttctggcaaacaggtaatgcagccctctgtcatgaataaccagctcgtcaaagcagccgctggccaccctttgaggcatccatcctttattccagttcatataataacggcccagctcacgcataagaggagccgccagctttggagacgccagacggtaatattccagcttcagggtactctcccgggttccatctcctgaattccatatcccatactgcatcgtttccgcctgtatcggtgcaaatggaaacctgtttatggaagaataattttccagcttctcccctctatagtcaagagtctggtattccatttccggctgctcttccagcctggaaagcggaagcagcacaggggatatttctttccaggagggatacttatccaaaaaggccctcgtcctgaaatccgattcatcccatccggcctccgatactttaccggtataaacggaacgtatccggcccgccccgtaatgaattcctcccgccattcccaataccaggctgataagaaagattattgaaagcaccctatataacagccccgggggattccctgttccgcgcctttttttctgaacagatgtccctgccccatccttacgatttccgtccgaagggttctccaggacaaaccgattccgaattccttccagaaggccatccgccacccgtgcttcccggaagctccacatctgcaatagcccgccaacccccattgccaggaaaatcagccaggctactccctttgcaaaaagcaggagaaatccatacccttgaaaaaaatagaaaaagaggaaccaaatcagccagaaaataaatggggaaaacagcccccatatccttcccctctgcttctttctcagttttttaaacagagtgtcgcccgcaagcagctgcacacgttcacattttcccggcattccccgcagtatcagtaccatacggcccagctgggtaacatactcccagccgaattctttgtattcttctccctgatccctggggcctttcataccgtcggggtccatgggtaccaccatatatgcagtttttgccggttcgcctttgataaaaaccgcttttcttccgctgtaccgtattaacacaagtccctgttccgcattttcttccagccagcgctccgccctgtccggattcgtaaaatcagcgggtatatttttaacgactttttcacttcttttcataaaaaaagcctccgtggtttgtcatctttttattatactattttctgcttatcccgaacagagaagagcctaaaaggatttcttattttttctttaaggtaaaattccctgtctttcttgacaaatcgccaaaaagtttcaataatggagtataataatggaatttctgaaggggtgtaacaatgaacaaaagaaaggcttttaacaataaaaagggctttactctggtggaaatgattgtggttattgtaattctgggaattctgctggcgataatggttcctcagctgataaaatatattgataaggccaaggctgtacagtgccgggcggatgtgagttatataatgaaggaataccagatcgaggctttggaaaaggatccgggaaatgcggaggcagcctgtgctcttctggaaagcatcgtcttagaacataacgggaaactgaagaaaaagggcgaaatatttaatggtggtatctattccgatgtatgtacctcaaaaggcctttatacttgtacttttgattctacatataaaaccgtaactgttacttgcggtgaacatgatgagggacagattgaagttaagaagcttgcagatgtgttaaataatatggattttacaaatatacccggctgtccacatcctaacctaaacgaatattttaaaggacccagaacctcaattgattctgaagcaatctctgtagatggttatggtgattatggttcttttgcaaaggtaattgaagcgaagctgaaagaacagggcattaatacagacggtcgaagctggagaatgtataaaaaaggagatacttataatcttttccttaccgattcccagaaaataaccctcaatatggatacacaaaaggttgcatgcacacagtatgatattacaaataataaagtaatccatggaaccataacagtatcaaaagataaacagggagtggaatactatcctatactattaggcgaatccttcgttcccgataaagagtaatgtaacctatacataactataaaaagaactgcgattgccgcccaaacaggcccatccgcagttctttattattttacagcttattcactttcagtttccgcagcttccggggtactttccgctgccgtaccgtcaccagcatcttcccctgtctctcctgcgctttccgtactttccgtgctggtttccggaatggtcagatatttcatatctcctgccacatccgtcacttcatatttctcagtcagcccattcatatactctccggctttctgattggcaagggtactggaaatagagctgttggtggtctgttcatcattgcttctcttaatgaattccacaacataatagttatggttcgtttcatccggaagaattgtggtatccccttccttacgggcttcgtcaaacagccagtccgaaatagctgcgggagccgcggaataggaaccgccttctatcaggcttccttccttgtcgtctccgccatagagatccttctgatcatcgatagcgttctccacacaaagggcttcgaaatcctcaccggcttttacagccttttccatggcttccgccttgaccttcagttcgtccataaccttggcgatatcttcttccgaagcatcctccgcggcatttcctctgaacgggaagcttctgtaatctaccttatcataattatttttgttggcttcgtaatattcctgtacttcttcatcaccgggcttattgatttccgtcagatgttcaaaataagcggtggcaagcatgttttcctctgcaaaaggccggattctttctgccgttgcatactggccgtacagcgaggtgtacgcctccgcctggcttacggattcgctttccgcctgcgcggccagctccgtatcaaatgccgacatatcctccgctgtgtcataggtaaagccctgcgccgcagcgtcatccactaacgcctttacctgagtgatctggctgaccgtcatctggtcaaaataatccttccaggtcatattatccgtatactgctgcttggaaaaatccgagctggtatccaggcccatgtaggacaggaaagaaccatacatggaaatgtagctgtttaccgaattattataatagtaatcatattccactcttgtaacatcatgatcgcctattttaatatagggattatgaagagcgctgtatttgctatatgcggataaaccgatggatatcacaatagctgcagcaattgccgctataataacgatactgcctatcttcaaacgcttctgcgctttacgctccttctcctcttcaattcttctcttttccattttccggtcatatttagtcatgaccttctcgcttttttcttccgtctgcttgttattagacatggtaagcttccctccttttatctctgtcaggtattatacctgataaatgtgaaacaagcgtgaacttttgcatgaatattccttcattatgtgaaattctgtacatcagaacacctttttcgcacaaataactgccgatacagcagaaaaaccctgtccggacagcactattcacagtataatacactcttcttccggcttcaacaaaaatccgcatgcaaattgcgttttttgtaactttcagccttcctcttcccttacccgccgtttttcttcctgaaccagacattccttcaggccgttttgtgtattttcaaaacgtattccaaaggaaagaagcctgtcctgggaaagccgcagatctctgggcttatccgcaaaggcttccctgttgggcacaagcagacccatatccgttccctgcagcctcagaagctccttaaccacctcatatgtgctgcattcattagggcttccgaaattataaacaccgccgggaaggaggagcgccttctccagatgacggatcatttccccaatatacgtgatgcttcggaaatcatatacaggatactgcatctgctttccttccttcagcgcctgccgcacactggtaaccagagtgtcgtgttcctcaggccggttctttttataatcaaacatccagctcatcctgagaatgactccgtccggaagtatctccaggcaccgtttttccgcctccagcttctgctttccgtaaagccgcttcggagacaaaacctcatcctccctgcgggggcccgtcgcatcattgccgaaataaacctgatcggagctgaaaaataccatccggcttcctgactcccggcaggccgccgccacattctccgccccatccacatttattttcccggatctttcaggctcattgtcacaaaccgccaaatcggatatggccccgcaatggatcacaatttccggagaatactcacagattaccctgcgtgtctcatcctgatccgtaatatccatctgcctgcgtgacactccccacagctcatgcctgtccttccaggcttccataattctggatgcggcaaatccctccgctcctgttatcattattttcatcacagcacctgcctctccgcttccggaagcgtattatctttcctctccccataccggaatgtatgggagaaaaacatatgaaacagctttagtaaaacggcatgccataccgtcttactaaagcttcctctttgttattttatccttttaatttagaaaaagccaggagaatgaacattacaccgctcagccatgataaatttaagttcagccgggacgcgatcttccttccgaacagctgtcctgcatacatggcccccactcctacaaggaacgccacaagcatagtcagaagaatattgagctgaagaaacgccgcaaaggttcccgccaccaggctgtcgatagacatggcaaaagccaggaatactgtctctctcatggaaagtgtgtgggaatggtcactgtctgcggccgtgggattcccataaatactgatgataaactttaactgggaaaaagaaaaatgaatatctttatgcacttcacagttatgattgatataatttttaattaatgaatcagcaagccggattgccccaagaatgaaaagactggtaaagcatactgccttcgtcagatcctccggaacgattgcctgaagaacggtaccaaaacacaaggcagcgcccagacaggcgctgcatataccgttcataacaccggtttctttccaattgatgcttattccgcctgctccataggcaatactggctacaaattcatccatacagagagccagacataatactaaaatctgaagcatggttatttctctttttattttagtatattcctgactcccttttttgacatacttttgccttatcttgcatatacggttctatgcgcagatgtccgctgctattcccggcgccttcccattaaggaagtatatgtcctccagcaagatatatctgataccattcctctctggtgagcacaatttcagaagcccggcaaatctcctggagccgggataatttcatggtgcccgccaccagctgcatgccggccggatgacgcataatccaggctgcggcgatagccgtgtccgtggtattatatttttcagccagctccttcagcagcttattcagctcctcaaacttgtcatttcccagaaataccccttcaaagaatccatactggaacggggaccaggtctggatagtaatgtcattcagacggcagaaatcaagtacgcttccgtctctgtccgcagcaccgtccgtcagcatgttcacttccatgccgtttgtgatcatattggaattgggaatgctcagctgcagctgattcgccgcaatatcctgtttcacatattttttcagaagctgtatctgggaaggcttatggttggaaacgccgaaatagcggacctttcccgctgcctccagcttatcaaaggcctccgccacctcttccggctccacaagggcatccggcctgtgcagaagaagcacgtccagatagtccgtattcagccgtttcagaatgccgtccgccgcttccagtatattctcactggagcaatcatacatcttgccgggtatgatactgcatttggactgcaggaacagcttgtctctctttcccggatttgcctgcaggaatttgccgaacatctcctcgcattttccggctccgtagatgtccgcatgatcaaaaaatacggcatccatatccagggctcctgaaagaaaacgttctgcctccccctgagacaaatcgttcatcctcatacagcccaccgccactgcaggaacctgcaggccggtcttccccaaatttacttttttcataatgatcctccttttcttgcggagtaaaatgcaatttcctatgaaatttgccctctgttgaacagaggttttcccctcctgttttctttttcatctattgtactttactttacgtgaaaaaggaaggatatgtccttattttcctatatttttttcggttacagtttattcccggttcagcccttaactaatacaataagctgggatatcccttccaccagaatggggataagaatgggcagaagccagatgagatttctcacaaaccagtttccgtttcccctcttcagatgtttttcttccctgctgtaatattcttttttcttttcatcgtcgaaatagatatcataggcaggatatgtgaacagggcggtaaacaccaccgccgcaaaagttccgaaaacagtcagggcctgtttttcccatcctgctttcaggaaaaccgcataaaggcatggccagaacagataccacatcgactggtaccatattttccggataagctttttgtccgttttgatttcttcaggctgcggtatgtctacaggcttctgataatcctcatacaggcttctgcatgtatggcacgtttccagatgggccttcaccacttccgatgtttccggtgacgtaagtccctctgcataattgggaagcaaatccctgataatactgcatgaagtttcattcctcattatttattctcctttccctgacttttgttttccttttcctccagataccggattaatctgcatttatcccgcataaaggtcactctcgcccaattttccgtcttttgcagtatcagcccgatttcccggaaggaaaattcattgaccagcctcaatatcagcagcgaacggtgaggttcctcctgaacattgatatagttaaaaatctccgccgcctgttctctgttttcccattgttccgaaatacctgcctcatgggaaaccacctcctttaattcctctgtaggcggatttgcacgcagccagtggtaatattcatgccgcgcaatggcaaaaatccaagtcttaatggggcagcttccccggaatccgcggattcctgatattactttcagaaatgtgttctggctgaggtcttccgccgtatgtgtattacggcacattgacagcaaataccggtaaacatcggcataatatttccggtacaggccttcaatctcattttgttcctgcatatccgcttcctcccttctgcttattagagcctgaaaaaataatttcgttacagttaaatttaaaattttaaaatttctgcctgaaacgcaaaaaaagcatccggctgtctcttaactaagagtataccggatgcaccgaatcaattctcacaaccattctttttccaaaaattccaccatatccagcgccctgggaggacatcccttcagggatttggcaaaacaggacgtacactgacccacgccgatattcccgctctgccctttatagccctgtccgatagcaaccgggggaaggccttttttcaattcgcccctgtcctgcaggcgatccagcgcataaatgagagaaccgaagcaggcgctgcaggcatccctgccgtccgtataggaagcgagcttttttaccctgccggtcatatgaaatttggatttatccgataaatcctcattcaggtaaaccacattggccgacgaggtatccatactgcccacaccaagctgttccgctctcgtaatatattccacctcttcgggagaatatcccatgctctcacatacaaaggagtcacaaagcaccggatccagaaaggccaggatccggttcataacaacaggattccctccttcttcaaaatcaagatccccgcagatgttatcaaccagaataaagtcattcctggcaaccgtgttcaggtgggcgatgggcttatgcagccccatggtatgaaaacgtcttttttccgaattgggaattacgcccttattatttttcagggcacaagtaaccgtagtctggcaatgccccttcaatacaggcatattgatcatgaaatccacttctgcggcgctgtcgcaaagccggatatccataccggccgcgtcataggttttaaaagtgtccgcctgcagatccttgagctccacaccatattgccgggaaatgcgatcatatcccgccgcacggaaggctgcgggagtgctgtctcccacccaggaactttccataatggttatattccggaagccattattctgcagatagcaaatcacgccctccagcagttccccatgggtggtggcaccctgggaagggtcctttgccaccaccaggttcggcttcatgccaatctttttatttctgtctccgattaagtctgccagtcctgcctgttccagcaggcgaatcgtcatgttcttataatctgtaccatgaataataaggatatcgttattcttcatcaacatgcagttttctccgctttttcttatggatgagcaggtaaatagtaggcatcagcagcagcgtaagtaatgtggacgccacaaggccgccgataataaccagcgccattccctgcatcattgcgccattgcttccaagtcccaatcccatgggcaccatggagaggattgtggtaagcgtggtcatgaggataggacggagccggatagctccggcatcgatcaaagcatcctccaaaggcatttcctccttcagctggttcaccgtatccacatatagaattccattatttaccacgatgccgacaagcatcaggaatcccattaatgataccatactgatggtcgctcccacaataaaaagcaggaaaatagaaccaacaaggctgaaaggaatacacatcatgaccatgaaggaaaaacggggcgactcaaactgcatggccattaccagaaataccaggaatatagcgatcaggatagaacgatacaggaccccgaactcttcattcataatttccgtcatcatatcctgcgccacttccacacctgccggataagagagctccctcacaacggaattcagggctttctgggccgtaaactgtgcttcctgagtagtggccgccgtaaggcttatctgatacaggccatccaccttcatgattgtctgcggcgcatccgtataaacaacctgcgcaatttccctgatgggcacctgaattccctggttattagtaagggttgcatccatcaggctgttcatgctgtcataaagtccttccggatactcaagcttgacatcatactccgtaccgttattggtcaccgtaagcacattcgtaccgctgaggatattacgtacgcttcccgccacctgcatcggagtcattccgtaatgcatggccatcataggatcaatttcaagcttggcggccgtactggtatcctgtgcggaggaagaaactttaataaccccattcaccttttccatggcttcctgggcctgcagcgccgctgatttaagagcctgcatgtccgccccgcgcagatcgatttcggtagtggatgaggacatcatgccgcttcccatactgctgccgccggaggaaatttccagttccatatccgtatagtccctggtgtccctgttccatttttcaatgacatccgctgttgtaagatttctgtcacttttcagatatgccctcatactggcagtggagccgctttctatactgacgctgtaggaacgtacgtcaggttctgctttagccagcgcttccatcttctccatggcagcttccttggcctccagagtggttcccggacggaaggatacggatactgccacaatcccttcatcggatgccggcatcagttccatatttaccctggtcatcatcagccctgccaccactacgagagcggcagtcactcccagaaccagccactttttatggagcagctttctgaggaaacctttatatacatgagttattttttccaggacacggtttgccggaatattctttttttccttcggcttaaacaacaggtaaaataaaggcacaagcgtcatagccgagatgagtgaggaaaccatggcaaacacaatggtgaagcccagctggccgaacagctggccggccagatcatccacggttgccagcggcaggtaaaccacaatagtggtgattgtggacgctatgattgacatggttaccgttttcgtccccttaaaggcggcatcccagtagctttcctcactgtccttccatcggaagcagctctctatgacaacaatggagttatctacaatcatacctatggcgattactagggaacccattgttacgatattcatggaatatcccatcatactcatcaggatcagggttgccagaatggataccggcatagagctgcctacaataaggctggccttgaaatccccgaaaaagataaacaggaccgccatggatatcaggacacccgctatcagcgtctttcccacagaccacagggaggatgtaatgatatcgctggaattatattcaatgctgatgtcaattcccggatttttttccatataggaatcaatgagctttattatcttctgtgttacctgtaccacgctggcgctttgttttttctggatggaaatactgatcgtttcccttccgtcgcttttgctgatcgtatccggcttttcctttgccatggatacttctgcgatatcggataaatggacgacactgcccgatgcggtaataaccggcacctgctccagccgctggaccgtattgaattccatggcggcgctgacggaaatgtcctgatttccctgtttcacgcttccggcgggaatcgtaaagtcaacggcccccagataattggcaactgccgccatattcaggccatactgcttcagcatatcctcccgcagaaggacccggatataatcctgggttccgcccgaaacatccacctgcgctacatccgttatggattccatatccggaatcagggtatcctccagggtctttttcagatccaattccccttccgcccggacattcagtatcatatccgctgattgggacatattcaattcgataaccacaggtgtggacgcatcctccggaagctgaaggctggccgtatccagggcagtccgcagatccgcataacattcgtcaatatccacgccgtattcatagctgaacatgaccatggaaacattctctgccgactgagaggttacggaatcgattccgttcagggtggaaccggaatcctccactaccttagtcaccagctcatccacactttccggatccgcaccgggatatgtggtcattacgatgagcatgggcatatccatgtcaggggtcagctgcattttgaagcccggaatggagctcaggccgaaaacggccagcgccagaataatcagaataaccgaaaccggacgcttcagcgctaattttgtcaggctcattttccggcctccccttctaccagacgtactttcgctccatccgtcagctgggaggaccaggtatgtattacgatgctgtcggcagacagcccgctcaggatttctatcttatcatcattataaagtccggtttccacaagggttttccttgcaatcccgtcctctgcacagaaaacataggcctgttcgccttcataataaaccgcatcataaggaagcagcattgctgatgatgcgcggtaggtatctgcagttatttttaccgttactccgttggaaagcgccgtattttccgttgccgccttgatttcaaacaaaccggttctggcatccacggactgtcctatctgggtaatggccgcatcaaaggtctctccgcttctttccagagtgattttttctccggtaacaagctggttttttaccgcctcactcacataaaaggtgaccgtcaaagaatctttgttggaaatgacgtagaccggatttccggcgctcaccataccgaattcatccacatttttctgttcgataacaccggaaataggggatgtaagcgtgtaattctccagctgcatttcggcgctcttgattcccacctccgaagaagcgatctgattctgcagggcggccgccgtatcctgataagcttggccgttctgtattccgtactgtacctgagcatccttcaggttttcttcatagaaatcgatggtatctcccgtggtggagcgggaggtttccgccgaatcaatgctgctgtctatggaggatatatttccgtccagagtggatgcctgggatttcatggatgctatctgggttgcaaaattggcaacgctgctgtccagacgtccttctcccacatccgcagcggtgtagccagcggatttgaactgggatactaccgcaagatttctttggtattctcctctcttcgtaagatactcttcgtagctgcccttattggatccaccagtggtatctacctgcatgatacgatattcttccgtcctgcctgttcctgcaacggcattaatagccgtcggttcttctgacagtgctccgtaccttccgcttttacctatggagaaaccttttcctgtataaaaagccactccctgagctttcggttcattccctgacgggctttcaggtaccgaaggactttcctgcaccgccggactttctgcagcactgctctttgattcctcatccgttgcactattctgtccggtaccttctggtttgctttcctcctgactggaggattcctccttttccggttcttcaggcgcttcttcagaagagttctgcccggaagaattcgtgccgccgtttcctgaggaagaggatcccggtgcagtcagaccgccgttggtattaagagaatccggattacctcctggtgttgtactgcctgtggatgagtctcctgcagaagaggtttctgaaggctgggttcctgttgacggcgttgtctcatattcttccccccagttcggttccggatccgttatccatctccacacgccgtatgtatcctgataaacatactgcttggcggtcttcgccatgtttttcatgttgttatagctggattccatgtcgccgatactgtcattgattttatccagcgcgcttttcatatcttcttttttctgctgggtatctgtaatggaatttccggccgtatcgtactgtttctttgccatatcaatctgatattgaatattcttgatattgctctccatggacagattgctcatcacctggctggaaccaagtgttctctgggcagaaagctccgcgccttccttggtaagccgggctgactccagctgcagacgggccgcttcgtcatcaatctgaagcagcacgtcaccggcctgaacctgatcgcccacctggaaatgcaccgaagatacctctcccgaaacaagaggaatgatgctgacctgctcctgggggcttatcgtcccgatgaaggtactggaaaccgacagatctcctacctccggaacagctgcttccacagcaagtgatgtatccgcagtttccgtttccgcctcatccgtactgctctgacagccgcccagtgccagggccgccgtaagcagaactgccaaactcttcatacggtaattttttttcataactgtacctctttattttgattacttagcattgctaactattgcttttttattctagctttctgttatatagaagtcaattaaaaaactataaaataagcattaatcatgctatactaataaaaaagccggataatggtctccggcggttttattgaaaagaggaaatcatgcccgaatcaaaaaaaataccctttgaattaatgaataaatttcaccgtttcaagttaagtaaatttcccatgccccttccggaaagcgaactcatcacattagccaccatctacgaggccaaccagtgggaaagcccggaaaaaacaatgatttccggactcgcggaagagcttcatgtatccgttcccaccatatcccgatgcctgcgcaagcttgaagaaaaagggctgatacaaaaaaacagccagacaaacgatcgccgcaatacgtacgtctgcctgactcccaaaggaactgagatatataatgaggccttccggactctgagttctttcgtggaacaggctttatcccgtattgacgaagaagaactggttcagttttttaccacctttgacaaaatttatgatgcccttgtcatcgaatataattccctgggtcaggaagatgaggcttttccccccgactctcctgattgagctcactcatccctcctcacatatatacggaaacagtttccatttttcccatagtcacttatggatacataaccgccctgatccccgatgatttttcttgtgaggtaaagccccaggccaacgccttcctgcagcatagcagcctgtttccccctgtaaaacctttgaaagaccgtatttctttccccttctggaatacggctgccctcactgcatacttctatacaggcatacagatcgtatttgttcatccgaagcaggatctccctgccctccccgtatttcacagcattatcgagaagattaaacacggcctccaccgtccattttccatccacacaggcgcggatatcccgatctccttccagcaggatctctttacccctctgttccgccctgggtgccgcctggctgatcgcttccagaacaatcggaagaagcggctgttttatcggctgaaccgtaatgatatccgtctccagacgggccgccttttcaaaaccttccccgaaccagccaagcttttccgcctgcctggatatattggcaagaaaaagcttccggttctcctcatccagctccggcataagcaggaaatcacaatacatccggatattggtaagcggcgtattcatctgatgcaccaaatccgccaccaggccgctgagcattgtcttaagctcctgctcctgttcttcatggcttttcatgattccataaagcttatatatctgcgtctgaagctttccggtgagcgtatcctcatggggattaaaataatttccgtccggcttttctccccaatgtccgtcaatcagagactgcgcacagtcacaggccagtctcaggcttttattcacacagccggacagccagaagaatcccctgaatactatgaagcattccagaatgccataaataaccccccaccatcgtacgccttccggcaacaggaacagcagtagaaaaaacagaactgttatgaatacctgtgccgccagaatccttcggatggtcctgtcaatccattcagttcccaccgcttcctcctgaattgattttacgtacttcacgcttctatccgacagcccgttcccgcctgcgtatatcctcattgttcctcccatttgtagccgattccgaatactgttttaatcctgcacggcttacccggatcctcttctattttttcccgaagccgtctgatattcaccgccagagctttctcttccacataattctccttgtcatcccacacccgggcaagcagcatttcccgggtcagcacttgcctgcggttattcaggaacagttccagcagccgcagctccgtcggtgtcagggcaacccgggtccctccaatgaccagctccttaccggcaaaatcataccggagactgccattgcaataaacctgaccgtccctgttcccgctccggttcagcaccgcctgtattctgcgcagaaggagggggacggaaaatggcttggttatgtagtcatccgcccctgcatcaaatcctgcaatcatatccttttccgtattcctcgctgtgagaaaaataacaggcacctggttttccttccgcaggcagggcagaaaatccctgctgtcgccgtccggaaggctcacatccagaataaccagatccaacgctccttccagctgccctctcattccggacaggcttcctgcggtcttcacctggtgcccttcccttgtcagggcaaacacaatgccgtttcttaatatttcatcatcctcaacaacaagtatacgggccatattctctccttattccacctcccgcagccgctccactaccggtttccttgtaaggaaacgggtcagcagtaccgccaccagaacggataccaggcacataaccacgagcagcagtacacagccggctgcaaaaatcttcgcagaaaacccggaaacaaataaaatcgcctttcccagcatataacagaaaaatgcacctaagggaatagccgcaagtgcactcagtccgctcagcagcagcccttcccggcacagcatggccctcatctgctttttcgtcatacccacggactgcatggcggcaaattcaattttccgcgataacacactggtaaccagagtattcacaacattgcagataccaatcataccgaatacgcccgacaaaaacagcccgataacaatcatggatgatttctcactgcgctcggcttccctcctcatgacctttgattctatagacagctgatagttaaaactatcctgcactgctttctccacctgagcatattcctcttttgtcagttcttttatggcatcagcctgtacaataccaaccatgttctgataaccggaataaatctcctgaaataccttgtcaggaaaagccagagctgtagaagccagcagtcctgtaggaaatgggttgctccgttccaccaccgcaagaacctcagcttctttgtccacatactgtcctctgtccggatcgtaaatagaaaaatgcagaacctgccccgcatgaataagacccgcttcactgttcgactgattcgttccctggttataaatcacatagccgccgtcagcaaatttttcttcatccagactgccttctataacatggatattctcttcctccagatgcagtttatccgccgggaatcccctgatggaaagacggatatcaccgttttccctttcgctcatccaaccggttcccaatttttcacagcggataaattcctcccggaattcttccgtcatcttcatttgcccgtacccggcatcacagcccccaaactcgttcacttcccagtctctggcctgataatacagaactaaatcttttataaacggcagttctgcaagctgtgacaacatatcatgggaaacaggctgatagggttcatcactgccccaaatcatagcatcctggcggatccgcacatcggcagtatggtagcgtttcaccatattttccacattgtagcccatgggtaaggtaaatgcaaccagaaaaataataccgctcaaggcgaaggaaactcctgcccacagcttctttcttcccgctcttttttcccgatatctggcggcttctataggtgagatccgcatggccagccggtatgccttcctcgcgcttatatatacggtgagcagggaaaaaacaactgccgaaataaaaaacatgggattcgccgaattcctgtaaaaatctttataattagtctctgccataaccacaggtgcaataaacaaacctaccagataacctaaaatcagcccagcagtaatccccacgcaagtaagccgggccacctgccagtttaagagagagcggatctgccttccggtggttccgattgtcttgagcattccgaagaaacggatatcgtttacaactgatatatagaatatattatagataagcagatagccgcagaacatgatcataagaacaaaaaccagcaccacaagcaggtacagaaccgtaaacccgttatccatccggtattggacaccggccgcacccacttcccctgctatatcatataactccccgggaatcgtatcttttatttctccgggaatgaatttcacataaatcccggccggttcctgaagcatctgcggcgcatatttttcggggaaagcctctgaagtatagatttcttcataagtatgggccaaacctttaataggtgaggttacgattcctgtgattgtcacggggatttccttttccacctgctgcccgtcctcccagataaccggatgcagtaccagcgtatcccccacattgcctttgccgcccagccgttccgccatagtatcggacactgcgatttcatccaccgactccggcagcctgccctccagaagagctactttatttctttcataatattcccgctggggagccagaagggctgtcttgattcccgacatttcccggttatgcaggcttcctatattacagtagattacgtaagctgcccactccacctgaggcatatccctgattttctcatatttttccagctctgccttgatttctccgtccgccagggggccgggcgtaatatccgttcctctgtttatggtatcataaaagctgatccctaccgtacacaccatggtaatcagcagggtggtaagcgtaattcccagaatggccgtcagattacgcagcttatgagccttcatgctttctcttgctatttccctgaccgcttctttgttggagttctcaaacatctgccgtccctcccacaatcctgccgtcttccatatgaatcgtcctgtcagccagctgggctatcgcttcattatgggttatcatgatgatagtctgatgaaacctggtgcttgtcatttttaaaaggcccatcacttccgcactcgtccgggaatccaggtttccggtaggctcatctgcaaggatgacagaaggcttgcccgcaatggcccttgcgatggccacccgttgctgctgtcctcctgaaagctgattcggaaaggcctttcgcttatccgaaatacccagcgccgaagtgattcccccgatatattcctcgtccacacggttgccgtccagacgtatgggcagcgtgatatttttttccacattcagaacggtgaccagattgtagctctgaaaaacaaacccgatatttcttctccggaacaccgtcagttcttcttccttcatccgggtaatgtcctgcccgtccaccaggaccgtcccctcatccgcgtaatccaggcctcccaacagattgagcagcgtagtctttcccgatccggaagtgcctaccaccgcaacgaattctccttttcttaccgaaagtcccacatgatcaaccgcttttaccaggctgtcgccgcttccgtaatatttaaccagattatctgcttttacgatttccatccctttgtatcctttcctgccgccctgtcccgactgcggctgtacaggcggcagtcagggttatgggctttcttagattactctaccatatacttcttacaatccggtaacaaaggataaagcaatcaatggttttgtttttcgcagataactggaatttacagatatgccccttttccgttaatcctccgtaatctcacggattttttcagcaggaatcccgcatatctccgccatttcctctacactgtgtccctcctttgcaagacggattacctgttttgccagaagaagcccctgttcgaaaccatctacttttccttcagaaattccctcctgccttgccatttccgcaatttcttccaatgctttgcacatattcacttcccctttcccactattcgtgtcctcatttatcttccaccacttatccacatgaagcagttctctcagacaatcatatgtttcataggaaatatggctgaattcctccgatctttcccggatatatctcttcatttccttcccgtctgacgccatcgacaggagcctgaaaatcagcttcaggtccgtccggaaattctccggatccacatcggaggcctgtaccagattcactttgtaattcgtcatgaatggtttcatatcttcaaactcttccggtatatccagtatatcaaaaagctccctcggcccatcccattccgaggttccataataaaagcaaatcgtaaccaccggcgccagcctgtcctcagccagcaggcccgataaaaactccgcactgttattgtaatctttctcccgccgatgcttatccgtcagttctcttatctgccctgcataatttaatgcatcataaagcatttccctcaccggcatggcataatgggttttctcctgcccttccacggcaaaaacagcatacgtagtattgccggatgctttacagatagcatctctgtaccgtctctccgatactttctgtccttccttatccggaaaggacagcgcagattctcccggcagtctttcaagcatatccgctctcagaacctgtcttccgcagaaaatagatccattaaataaatcactgaaattctccggtttctccagaaattttttcactgccaaatcttttctctgtgacataaaagcacatctcctccttatggtttgatgataaatccaaaagatatgtgctttatacagattattatagagatatcccgataaaaaagcaattcctttggatataaaaaagaaagtaaaaattggaatagttggccgatacggccggtgtaagaaagtctgatgactcaataaagatgtttattcttaagaatataattatgatactttataattggcagactgtcaatccccagtctgccatccatccggcattttattttatttttattcttgtatagtattccttgtcatccatatggtggatgtatgccccatttttttcctgcactcgtaaggatgccggattatccctgtttaccgacatataaatctcatcctcttttaccagtctgcgcgcttcttccaatgcctgtgccagcccgcgggaagcatatcccttccctctgtattccttctttattccgtatccgatatgaccggccccctctctgagaaaatcgttgagaaaatgcctgattcgaaacagtccgacgatatgattatcctcccagagaaaaaaatccgtttccggcacaaatccctccgggagtccgaccccttttgaaaaatcaatcatttccggaagaactttctgcataaaatcttcttcggaaactccataatacctatttgtaaatccattttcattggctggaagattcgtgatataaacatattcttcctgcgcatcctgttcatttacttttttcaaatacagcattccgttctcctttttttctgtctgcctgtgttattctctcatgataatctcagcgatttctttcgcctttttcccattagccgttttctgattccctggatcattcagataaacggcaaaatatttattttgctccccattctgcacaaatcccacaaaccacccttctccgtcaggaccggttcccgtctttccgtaaagtgtcaatccattttctgtatcattctgcatgttactacgcaatatctgcgtttcttcttccgtatagctgctgccgccttcaaaaatacgggcaagtacctgcacctgctcccaaggtgagatacgaagggaagaatccagccagaaaccgttcagctcaggaagcggattcacatccccaccctcccattctgttatattacaattgccataccgcagttcttccagttccttcttcacctccgctgagcccaccgcatctatcacctgacggaaataccagatacaagaggtttgaaaagcttctctgagggacaaatccttattccatgcagaattataatattgagtgccattgtattccattgcagaagtctcatccgcaataactccgttatgcagccccataagtgcagaaataatcttaaaagtagaataaggggaagcctgctccatacacatctctttattatagaagtaactgctgttatcctccggtacataaacggctgcacagccgtttattccctgaaaagcctggctgtagtccacatccacttctttctcttctgccatgtaaatcgacacagcttctgaaaggctttccttcaccgactcttctgttatatccggcttctcctcattttcctgctgcccggcacctgtctcttctccggtgcctgccccttctccactcaatgcccctgtttcctgagcctgttctgcttttcccacacatccgctcatgctgattatgcataaaagaaacaggaaacaccctataaagcgtaatcctgtataactgcctgttttcacttccgatatcctcttatttttcccagcgccgccttccgtctttccttatggactgccaaatattgatgcgattccataaattcctgaaactcctcttcacccagccagaagaaaaaatcgtgtccccctcctgaaggcgaatcctgtccttatccccggcggccttaattcccttatccgtaagccacaaaagttcctctccattttaccctctgccgccctcaaagtcacttgttttttccctccgggggagtataattttaacagatatcacttccggaaaggagtaataaaatggcagtctattacagcatccgtccgcagctggcggaaatccccgctcccgaaaacgaagactcccaatccagccttccccatataataatcatgactcccgaagaagccgccaacggcacatttctgcagacaaatatgtatgcaaagctggagcattctcaggaggtccgtttctgtaaagcggaagctcataaggattttttatacggcacctttgttattcctcccaaaagcaataacagggaaaaaattgccttccgttaccttatcgcaaaggaccggattgtctttattgaagacggcggttttgtaaaacaaatgatagataaaatgcagcaggccatcctccgggagaatccgggtatcggctttttcttttccgattttctcgatatgctgatttcggaggatttgctttacctgaccgaaatagaaaaccagatagctcatctggaggacgaggtacttgcaggcactcttgaaaatttcaatcacaaaatcatggcctgccgcagaaaaatcctcgtctgttcccattactatctgcagctttccgatatcagcaatattttacagcaaaatgatcatggttttttcacccggaatgaactggcttccttccgtcttttcagcgagcgggtgggccggctgcatgaggaggcccttatgctccgggaatattccacgcagctccgggaggtctaccaggcccagattgacatccgccagaataaaatcatgaaaatcctgaccgtggttaccaccatttttctgcctctcacactgattgtgggctggtacggcatgaatttcaaatatatgccggagctgagctggaaatatggctatcttgcggtaatcctgctgagcgcggtcatcgtctttttctgcgtgcggatatgccgaaaaaaacattttctataacggttccccaccttctcacataaaattccctggccgccggtttccctattcctcactcccttttccagcgcatctacttttcaatccaataaaaaaatccccatccaatcacggctgcccatcttaaacagatggttcagcagtccgatgatcggatgaggatcttgttaccggtattttatgcctttaccgctccactgttccgttcaaacagcttcttaattccctgtacagccacaatcactcccagaatcagaagtaaaacagcaaatataagctggagggtattgcccagactcaaaccggttgtaataaatgcatttcccagtttaaaaatagtcattcccaaagcagtaaaggtaacagccatcataaacaccatgggaatccacagcatggcgccctgccttttggtccgtttcaggaaaacggcgcaggcgatcagagccagaacagaaagcagctggtttgcggaaccaaacagcggccatatttccgcatatcccacctttgcaagcaagtatgccagtatcagcgtaatcgcggtggcaaaatacttattcgtcactaccttaaggaaaggactcatgttttcttcatccgtatcgtcatccatgaaaaactcctggaaggaaagacggcctacgcgggccacggaatccagggatgtcaatgcaaacgcggaaacagccagattgattaaggtgaataccaggctataaggaaggcctgccgccgtcaggaaattggcaatcgcccctgcgaaaatctgaggctgtgtggtaagcccctgagccgccgcttcccccttggcaaaggaggccactgcaatcagggcaataattgccagcatgctttccatcagcatggcgccgaaggataccgggagcatgtttttctcatttttaatctgcttggaagcggttcccgaggataccagggaatggaaaccggataccgcgccgcaggcaatggtaacaaataaaataggaaacagatactgcccatccacatggaaaccggaaaaagcttccagattacatgccgggttagctacaaaaataccgactacagccgctgcgatcataaatacaagcagataactgttcaggtaatcgcggggctggagcagcgcccatacgggaacgacacaggctaccatgatataaaggaaaatgatgatgtgccatactcccctgcttaaaaagatggggaatttcagccctactgccacagcaaccaccagcatagctacagcgataactgtatttaaccatttaggaagctttccatattttaaaagcatgcccaatgccaccgcctctataataaaaagcatggaggtcgtggctacagcgccgtttgcggtcactttcataagctcaccggcttcattcgccgtaaacccgttaaaggttccggcaactacatcggcaaaagcagcaaccaccagaatacagaacagccagcaaaaaagcagaaacagtttctttcccagcttgccaatatactcttcaattatgtatccgatggtacgtcctttatttttaacagaggcatacatggaggcaaaatcctgaaccgccccgaaaaagacgccgcctattaaaatccacagcataacaggaagccaaccgaacaatgccgcttgtataggcccgttgataggccccgcaccggctatggatgcaaattgatgcccgaataccacgttggtatccgcagggacataatccacaccgtcttccatttcataagccggagtctttgcattgggatcgattccccattttttctccagataccgcccatacaaaagataggctcctcctaatactacgatggcaataaccatcatgagaattccactcattttctacctctctttccgctgccggcggcagctctcctcattgataagatgtacacaaacaatacagcctaagggaaaccacaaaaaaacctccacagtccctgaggactgcagaggcggaattcatccgtggtaccactctgcttgccgcataaaaataacggccgctcgttttctgctgtctttggttaacagcatctctgttaacgtagagaacccgtcccaacctactcgtaaaactttcagcgggatgctccagggtgatgttacaatggataccataccgcctttcaccagccggcggctctctgtcatgatactgcccatgtaatttatcccattcactgcattttttatgttattaatgttttaccacgttactgtaaaaaggtcaagcaaaaactttttttacgcacactatctcactctcacatgatgcttcagcataaagttctcatcggaggagcaaaggtacatgataccctctataaacccaacgatggcaggaatataggtccagcagaagcagatatacagaatacccattcccaccttgcccatatagaatttatgtatcccgaatgtccctaaaaagataccgagaaggcctgcacagagcttgctctttaccggccaggaaggatcaatggcgggattgttataataaccgggcataggttgctgataaccctggggctgcggcggaacctgataaacctggggctgcggctgtccctgaaagggattcggctggggacctccctggaaattgccgtatcccggtccctgctgataaccgtctccataagccgggcctgactgataaccgccctgctgcgctccggcatccggctgcactgccgactgttgaaaagaaagtctttctccgcagtatttacattctgttgcacccgcatccacaggcgccccgcactggggacatcttaattcattcataataaaaccctccgttactcatattttactacgctttatccttttttcccaatccaattacagggaatatttactgtatcttccttccgcactcatagcagaatttagcgcccgccggaagctttgccccgcattcgcatactctttccaggaggctgaacccgcattcatcacagaacttggcatccccgtcattttcttttccgcagctgggacagcgttttttctccacctccagctttgctccgcaggtattgcagaacttgcttccctgtacggatttttccccgcatttcgggcagatcaccatctgtccgggatttatccggggagccatcccccctgccgcctgggccacgttcatcccgacccctgcgccgattcctcctgcggcaaaagcgcctgccactccgttattgttattggccgcaccctcataaacatcaaagctgcgcttcgtcacataacggccgtcccccatgatttcaaaagcggccttatcttccaggattttattgatttttgcaaaatcatcatcagggaaatttatggactgtacaaagaaattaaccacgttgaatccgtatttctggaattccccggaaatttcctccctgcatttatcagaaatatcatccagatgggccgagatttccaaagcggagatcttctcagccagaatcatctcagaaatgatggatttcactttggtgaccaccattccacggtaaaacagcttgattttatcaaagctgacaatatcattctgattcatggagccaatcagttcacggaaaaagaggctgtaatccatgagtttaagacccatctgcccaaaggcccggatcctcagcttcacaaaatatttaggatcgatcagctggatcggatccgatgtcccccagggtatatccagcttggtcttggtattgatgaaatagacctccgctgtaaagggagtattccctccatagggaagattaaatatatggaacaggacaggaagattatccgtatccagaatataagaacccggataaaataaatcacagacctggccgccttttacaaaaacagccacctgcccttcattaacaatcagcctggtgccaaaaaccaacgtgtcggacggaaacttgtatacaagccagtctctcgaacgcagaccatcgaattttacgacatcaataatcgccatgtatgcttacctccatatgttgtgccgcctaactgcttcttgctttattttaacatatatagagtaaagaacaaggcttttttaccgataatatacaggccgtaccgtgcagcaggtacacggcgcggcctgaacagcagatctgccgttacaaggtttccagcatctgcaccgcattttcaccgggcttcaccttggtaaaggcttctttgataatcccctcttcatcaatgagataggtggatcgcaccactcccattaccttttttccgtacatattcttctcctgccagacatcatacttctgtatagcctccagctccggatccgaaagaagggtaaaaggaagaccatatttatccgcaaatttcttatgggatgccacgctgtctttgcttacacccagcacaacagcacccttttcccttatctgggggtacatgtccccaaaagagcaggcctgtgtggtgcatccgggcgtgttatccttcgggtaaaaatagagaatcaccttttttcccagaaaatccttcagggagacttcctctccgtcctgattcttcaaagtaaattccggcgcttttattcctgtttcaagcataactgctacctcctgtaaatcatccatttctttcccttaccataacatacctctttatctctgtgcaacatgcatttacagacgcttcaccgcatagctcagtcccgataggactccgctttcttcttcaggccctccagccggttcagtgcttcatacagggtatcatccctcttggcaaaatggagccgtatcaaatgatgcacctcttccctgaaaaagctggagccaggcaccgcgcccacacccactttttccgccatccattcacaaaacctcacatcatccctcacaccgaattccgagacgtccaccagcacataataggcgccctgaggttctgtaaaggtaagccccaggtctttcagcccgccgataaacaaatccttcatgtgggtataatgcctgcgaagctcataataatactcatccggaaaagcaagccccacaacggccgcttccatcagcggcgctgccgctcccaccgtaagaaaatcatgtacctttttgatccgtccggcaatatgaggcgccgcgatcacatagcccagacgccaacctgtaatagaatacgttttggaaagagaactgcaaatgattgtcctttcgctcattcccggaagcgaggagagataggtatgcttacagggttcatatacaatatgctcataaacctcatccgtaatgacataggcgtcatatttcaccgccagatccgcgatgatccgaagctctccataggaaaatacctttccgcagggattggaaggattacacaatatcagcgccttcgccccctgccggaaggcctgttccagttctcccacatggaaggaaaaggaagggggcttcagcgctacatatatcggttccgcgcccgccaatatcgtatccgccccgtaattctcatagaacggggaaaaaataattaccttatcccccggattcgtcaccgccagcatagccgccatcatggcctccgtactgccgcaggttacgacaatctcctcctccggatccactctcaccccggaaaaatgctcctgctttgccgccagggcctccctgaaattttgtgcgccccaggtcaatgcatattgatgcgggccttccttcgccgtctgcgccagtctgtccgtaacagcctccggcggatcaaaatccgggaagccctgggacagattaaccgccccataccggttggatattctcgtcatcctgcggatcaccgaatccgtaaatccggctgtcctgctgctcagttctttcatcgtcactcctgtccgtgtgcatcggcacacctgtaatcttttatgtgggaaaacccgttatttccggtccccttcccctgaacttctattcccaggccggaaggtaagaacctttaaaggcttccttatacacctcttttaccgcttccgtctgatatgcctccacaatccgcttatacacctcattatccgcttctcccttacctgccgcaatcagattcacataattttttccttcatatatatcaacactgtcctgaaaaatggaatccttcccgggattcagcccgttatccagggcatagttacagtttaccacagctatcgccacatcgggaagaagcgcacatacattagcggcatccacctccaccagctccagctgcagaggattatccacaatatccgtaacctccgggctgtcccccgccttcttatccagagctatcaggcctgctgcctccagtaccttcagggctcttccttcattggaggcatctccgggaacagcaaccttactgcccctttgcacctggctcacatcggtaagattccgggaataaatattcatagccgaaataaaggtatccccgattgcctcgatttcataaccatagctttctatttccttattcagataagcataatgctgaaatgcatttaagtcaatttctcctcctgcaagagccgcgtttggcgtggaataatccgtaaatgtaaccagttcaaggtttatcccctccttggcaagctcttcctttaccggatcccacatttcctgggcttcccccaccactccgattgtaacagttctgccgctctcctccgctgacgcctgttttccacaggccgatatgcctgacgccagtaatatccacaaaaaaaccaatgctgtctttttcataatttctcctcctgtctgcggccgggccgcagattcctatgcagaagccgctccatcattttgggccttccgtgttttctcataccatgtcactgccagttcaaagttttccctcataatcctgcaggattccccgaatttttccttctcttcctccgtcagcttcagctccactactttcttcacaccttttcttcccagaacagcgggaaccgaagcatagacaccgtgctgcccgtattccccgtttaaaagggtagatacgggaagaatggtacccttatcctcccagacagccctcaccacctctgccagcgcggctccgatgccgaattccgtacttccttttccctcaagtatggtccagccgcctccgcggacttctccggccagtgactcccagtcgatacggccatatttttccttgttttcctctctgagctccgaaagagtccttccctgtacggaaaccgttgaccaggccgcgatctggctttctccatgctctcccaacgcatagccttccacatcctctatggaaactcccgcagcctctgccgtcaccctgcggagtctggcggaatccagggcagttccggtagatattattttaccggcaggccatgaaagcaggtactgcagataatgggcgatcacatcggccggattggaaatgctcaccagtattccatgaaaaccggactgccggatttcttctgcaacatccctgataatcgccgccgtagccgcgagcgtatccattctcgtctctccctttgccttatccggattggttcccaccgcaattaccatcacatccccgtcccctgcatccgtgtaatctcccgcttttatttttaccggataaggcagataagccgccgcatccccgatatccagcgcctgtgccgctgctttttccctgtcgatatcaatcaagactatttctccggccagcccctgggaggcgagggcataagccgcgtgggagcccacatgacccgctcctataatgattatttttcccgcttgtttcatcgcttcttcctcctgtcttaaaatcaatgtgtatgcttcttcgccgccatattccctgccagctgtatcaggctcaccaaaccggccaataccaggatggatgccagcgtcacatctgtctggtttctctgatagccgaaacgtatggcaaaatcccccaagcctccggctcccactgccccggccatggctgtcaggccgatgaggctgattgcggtaattgtgaccgcacggacaattcccgggatgcattccttcagatatacccggaaaataatctccacggaactgctccccatggacagggccgcttccacaagccccggatccatttctgccagggtcgattctatctgccttgcaaaaaaaggaatcgtgccgcataccagcggtacaatggctccctccaccccgatagccgtccctgaaatcagtctcgtcagcggaatcagtgcggcgagaaggataataaatggaatggatcggaaaaaattaatgattttatccagcacctgataaagagcccttgcctggagaatacctccctccttcgttaccgtaagcaccacaccgagaaacagccctcccacaaaggctatcgccccagcccggcctgtcatgcgcagggtatccagaatacttccataaaaatccggcagctttgccatcacattcccgaaatatgtattaagaaactcttgcatccgccaatacctccactcctacttttttctcccgcaggaaatccactgcacgcctgatattttctccgcttccgctgacaatggcaaccagcccgcctatgggattctcaccaatcagttctatatttccgaatataatatttacattcagggaaaaatccctggatatttgtgacaccagcgcctccgacgtatttttatgcagatagcgcagcctcaggatacattcccctgctcccaaacgggtaatttccgccttttcttccaggtaagtatagattctggaaagattggaagcgttgtttacaaaatcctcggtgatcttcttttgtgggttggaaaagatatcaaaaacttctccctcttccacgacgctgccgccttccatgaccgccaccctgccgcagatctccttcacaacctgcatttcatgagtgataaccacaatggtgacccccagcttacggttaacctcctgaagcagccgcaggattgccgtggtggtcttgggatccagcgcgctggtggcttcgtcgcaaagcaggatatccggctcgtttgcaagcgccctggcgatggctgctctctgcttctgccctccggaaagctgtgagggataggctgaggccttatcctccaggcccaccaggttcaaaagctcttccaccctcttctttatctcctgcccggtcaatccctggtgcttcagcggatatgccacattttcatatacattacgggatgcgaataaatggaactgctggaatatcatcccgatctttctgcgctgtttcctcagtgatttccctttaagggcggtgatttccatatccccgatccatatccgccccctgtcaggtctttccagcaggttaatgcacctgaccagcgtggattttccggctcctgaatatccgattatgccgaagatttctcctttttttatatgcaggcttacctccttaacggcctctacctgctttccgtttccgcggaaggttttgctgacattctcaaagcgaatcatgtatggctcctttctgactgacaatcaaatgtacaaaaaaacagcggctgcgctttttatctgcgcatccgctgtccctgttttatccgttcacataagggaaaactcagcctccatacctgcgtacggccgttttcatgcgcactttattaaacatgccttccattctgcacatgcccatacatcccatattcgccatattcataacaaaaccatctgctgtatgcataatctgttccctcatcctttcttcattcttcctgtatcaataaggcagcaacgtccggccgctctttattccatttctcccgtactgaccttatgctgttattataacagcccataaaaataagtgttaatatggaaaaccaatattccgtcataggcaaaacctatagcagtttatccttataagccagcagttcctcgatatatacccttccgatacggctgattccggctccttttctgcggatatagccaatcctcattttctcgctttccgcaaggggcaccgctttgtaatcggctccgttcagttcctcacagataatgccggagcaaagggtataggcattcagcccgaccatcaggttcaggagagtagccctgtcatcggcctttattattttcttgtattcataagtgctcttcatttcttccgccagataaaaagaattgttttttccctgatcaaaggcaagacagggatactcctccagctgatccatggaaataacaggttctcctgcgaggggatggccgctccataaataaacatacgtatcacattggaacagttccgtaaattccaggctgttttcccgcagcagcttactcatcacctgttcattaaaatcattcagatacagaattcctatttcactgcggaaatttctaacattctcaatcacctcatgggttttggtttcatggatggcgaattcgtattgttccattcccacttttttcaccatctccacaaaggcctttacagcaaatgtataatgctgcatggaaacactgaattttttcttggattctttatccagatatttatcggtgagcagacggtactgctccgccacctgccttgcataacccaggaattcttccccttccggcgtgatcacaattcctctgttggagcgcaggaaaatatccagcccgatttcctcctccagctcctttatggttcccgacaggctgggctgggaaatgaacagacgtttagccgcctcattcatggaaccacagtccgctgtcattatcacatatcttaattgttgaagtgtcatggatttttcctccgccggtgctctgtccgtctgtttatcctgtttcagacgtccgaaaaagctttctgctgtaagcagtataccatatccagccttttgcggcataccttttccagaacggctctttcgaaaaaaaactatcattatgaacaaaggaaaacaggccttccgaagtatcatcaccggaacgcctgcctgatttttcagttatcttttattcctccctgtctgaaacaaacagactatacgaattactctgccatgaagtaacttccgcaatgctgtccttatattccatcagacagcccagcatttttttcctcatcctgcggagcacatggacaaagccctgtaattctgccagattataaagttcaccgggatcgctttccatatcatacagttcatcctgtccgaatggattatacacatatttccactttctggttcgtaccatccggctcgtaagaagggtggactcatagccgttaaattcactgaaggattcctgccgccagccctgcggtacttctccctccagcatggacatcaacgattttccctgtacctcttccggcacaggacatccggcggcatccagaaaggtaggcatcaaatcaaccgtattcacaaatggattcatggtaattccttcctccttgccaggacaggatataatcaacggaatatgatgatcttcttcatacatgttgaaacctttattgaataacctgtgggatcccagcatgtccccatgatctgtggaaaaaacaaccatggtatcctcagcaaggccaagatgctccaatttactcataatctttcccaccagactgtccaggtaactgcagtaaccccaatatgccgcaattactttctgccagtctatccaagtcagctgtgccgtattccatctcatgagttccttctgctggaccaccggtttgtcccggaatgtttcattgaaattctcccatcggggtacatcctcaggcctgtaactgtcacagaagggtttcggaactgcataaggaaaatgaggtccatgaaaagccgcacatatcataaaaggcttttcccctccggcaaaatcttccagcatccggcaggctcctgcggcaacccagccatcatgatgatcctccgcactgagaacggacgggccgcagaaagccgcatcttccccccactccagatgctggacctcactgactcccatatcatagtcaatccctttctttttcagatactcatcataatctctatccgtatcccaggcatcaaagctccagacctccttatttccttcctccggaagatgccattttccaatatatcctgtttgatatcccccctttttcagataatgggaataccctttccacctcagcacctggcgatcaaatacaccgttaaaatttcccatattggaaagctggccatgcatatgtgggtatagtcctgttacaatgctggctcttgccggcgtacaaagggcgttcactgaataggcacttgtaaaattggttccatgctgagccaggcgatcaatttccggtgttctgcataccggcgctccattacaggataatgcgtcaaaacgcatttgatctgtgagtaaatataaaatgttcattatttttcccttctgctatttattttttcccggtacctatcccttaacagcccctgccgacagtcctgcaacaatattcttctggattaatatatacaatatcagtatcggcagcatggtcataataaaagaagcaaaggccagattataatcaaaggaatactgtgacttgaaattatactggaacagctgtaatgtccagcttttcgtacttccattcagtatgattaagggaagctgaaaatcattccagataaacagcgaatctttaattaacaaagtggacagaataggttttaaaagagggaacacaaccctgaaataagttgcaccataactgctcccatccatatacgctgcttcttcaatttgttcaggtaccgatttaagataacctgttatgagaaagacccccggcggcgtggtagctgccagatataaaaataccattcccagcttagacatcagatgaagctgactcatcatctgaaccagagataccatcctgacctgaaatggaacaaaaagcccgcacacaataaagatatacagaaaacgataatattttctattatttcgctgaatactgtacgcggccatgggcacaatcaacagttccacaattaccgaacagaccagtataaccgccgtatttaatatataccggaaataataactcttatttaatactgaaatgaaattgccaagaaaaaatgaagagggaagggcaaaaaaactgcttcctgattcctgaggtgtcttaaatgccgtaactatagtcacatacataggaaaaataatcagtataatccccggaagcaaagccagaagcacaagcagattttttcctgttttcttcatattaatcctcataaagttcctccttcttcctgcccgcttcatgactcttttgcctcaacaaggctcataacccgtatttgcagaaagccaaataaagctatcagaataaacagtactaccgagttagctacggcataactgtagttaaaactctcaaaagcagtctgatatataaaagtacctattgaattggtagaacctgctggtccgccgcctgttatggctaaaatataatcaaaaaccaggaaaccatctttaactgccaaaacaagcacaatagtaagagtaggtgcaaggaaaggaagagttatacttaaaaaccgccgccaccatcctgccccgtcaattgcggctacctcatacaattcctgtgatatggattgaagtcctgctattataatcacggtaggtattgccactgcctgccatatattggctattagaatcgcctagatagcagtgcgggtatctgaaacaaggcttttgctcaaaataccgattcctgccgcttttcctaatgcaggcaaagccctgtaataaatctcattaaatatcagtccgataataatcggactcataaccgccgggaaaaaataaatagttttaataaatttaattccttttaccttttgattcagcagcagtcctaaaaacagggaaatcaataaaatcagaagactaagcaaaaccgcatacttaactgtaaacagaatagacgaataagattttctgtcccttaatatcttcatataattttccataccgataaactgaaatccctttgcgataccattccaatctgtaaagctgtaataaagtcccagaatcagtggtaaaataaaaaagatcccataacacaaaacagccggcagagaaaacaaaaagaatgtgacctgcttttctttttttctcataaatatctccttacctcgggataatttcatccaatgatgaaattatcccgtttttattctgatttcaaggttatactatcatttataaaaatccggagttatcatattcacatccttcaggtaaccttccaaatcctcattcagcagcatagctgatatataatccatcaatgttgtattataattaacaggccacatattggacatcatttcataaacatctccccggtcaatcatctgataggcatcctcaaactcagaaatagtatttttcaccccggtaatacaggacattgagccatccgcatcattaaaaacctgggcgttttccggcgcagatataaattccagaaactctttggctccatctatatttttacttccctccgggatacacaaacctatatcaatgttcatagaaagatatgatttttgcccttcttctgccggcatagggatgaacaagaattccagatccgggttcacttttttaatattaggataagcccacgttccctgaaaaaaggcaattcctctgccattggcaaaatcatcacacatctgaggaaaactggtaccgaaaggatcctcctgcgaaaaggaaaacagttccagcatctgctgagcggctctgacaatttcaggaatatcctccgctcttttttccccacttcctatagccgcaaaatcagctgcaaaatcatttcctgaattcatgtacagctgtcccagcaaacgatccatcatctgccacagagtccaggtatccttgcacgcaaacagaaatttaccgtcttccttatctgcagtcttttccaataatgcaatcaactcctcataggtctccggtatgggaagaccataagcatccaataattctttgtttaaatagactcccatagtatttatagttaacggcagagcatatatcttcccctcttccgtttttgacatttccagaatactcggattaacatggttcaaataatcatctccggtaagttccagtatctgaccgctttgggcaagtacttcaaaatcaggcctgagcggaaaatgattgaacagatccggatattcctcactgctaagacgtgtagtcaatacagtatacgtatcaggcagattgacctgctccacatcaatatccggattctcttgttcaaataaattgattactttctcgtatgcatcaacactttccggcttaccctgcaaaaattccacatgcaccttccccgtactgcctccgctgtccgcagtttctgcagccgtcgcctctgtatttccgttcttgccgcctgctgtttccatatccgctgcatttccgcatccaagaagtcctgctgtcagtaaaagaattatcataattccagcttttttcataaaaccatcctttctcccattggtaagttctaccatacccacatttttctccacctacatcattaaaagcaattgacatattttcatgcaatatatacaattaatatgtcgcagtagttatagctctatataaaatattttatattgtatctacaatataattgattttgcagaaaaaacaaacgaataaatacctataataggtggatttttctgaggtatcatatgtttcttgaattaaaaggcatcccacaatttgtagactgcggaaagctggtatcaaccctccctttccttcacgcagatcgtactaatgctgaatatctcctgctgatgggaataaaaggagaacttcatatccgtgtcggggaaatcccatgcaccatcacacccagggatatcatgattattcttcccgggactcccatatccggactcatcccttccagacagctgacctatttctggtgccattttaatatgtctgaaaaaccgcagtttctttcccaacaggaagcgatcagccgctatcaggtcatgcttcagccgggtgatacagacagtcccccgctcataccacaaacctttcatctcatcaattcctccagagccattattttcagccagcagctgttgaattaccggtgctgtccggaatatcccggttccatcctccataacctgcttagctgtctgctgatcgaattatccacccaggccgcagatagtttttcctctatcaccatcggaaaaaaccaccagcgtctgcaggaaatccttcaatggatccgggtaaatgcatgcatgaaaataacggtctccgaaatcgcagaccggtttaattataatccggattatctttcccacctgttccatgaaaagctgggtatttctttgaagcattatataataagagttaaattggaaattgtaaaagaagtactcatatcgtcagataaatcgattaaggaaattgcccggtatgtttcttttgatgatgaaaaatacctgatgaggctgttcaaacaaaatgaaggggtcactcccagtgaataccgcaacgcctgttcccgaacaaaattcaataccaatctgcgtgtatctaaacggatagatacacgctgggtatcttttcttgaggaataaaatccgcgattactcaaaccagtcattgataaggggaattatatttataaccggttcttcataaggatggatttccctgatgaccttttgagcttctgaaacaagtccgaccggacagagtacctccagctttacttcttcccctgtacaaacactgcccttttcaccctgaaacggattgctgtcctccagcggtctccagcagccttttgtttcctgccaggagatcacatgatcatagctgccgattttacaggctcccaaagctgtaagggaatcccgcaatacaacaatatattctgccggtgtataaatttccagttttacctgtgtgatgttgcttaaatccatatctattatcaacctttcattgctttcgctagtatttcttctttccaaagcaccttctgcagctccagcgtccatttcttcgcagcccggttcggatgcggcatactgatcacaagagttgatttcccctcgcacactttatcagtccggaaataccataaatccggctcccgttcccgatctttacgttttcgtggatcgtaccatgcacgatcttcttccaaaatataatcatgtaggaaatctgaaaccattccccagcctcctgtcaggatgatatccggctgatacagccttacctgccgtcgtaataaatcaacatcttccaaagctattttcttcacttcacggttatttgccctggcacttccggcatattttttcaggtttatggcagcaatctcttttatagaattatcaagtaattcccggtcaactcgatccagataaatcccgtccaaaatcattcttgtccatcgggctacattgttccaggtacgataataggtatcactgcccccattccgaaggaattcagcaaggctgccttccagcgcatctgtttctttcaaaattacaagtatgtgctttccttcaggcaattgtgaccatttttcatagctgacgatgccatcctgattaaaatatggatattctatatgacattccttccattgcttttcccattcactcatcagaatctgttcttcatttaatatatcagatactccatttatcgcctccaaaaattatcacacctcatcccgcaaaaaatcatcataacaacctttcttttattatactgttctgcgatacataataccatcacaataacttcaaaaaaacccacaaacataatgtttgtgggtttccattgcatatatgcaaatgattatctcttggagaactgaggagcacgacgcgctgccttgagaccgtactgaaattctttgattgccgtttttccttgatattctaggcttttttgccctttcggttctcggttgtcctattccttaaccacaaaaataggtgttttttcaatcagaagcccctctgatgtagcgcatcatttaccacctcaaataactcctcaggcttattgtactttacctttgcatagatgtccatagttgttttgctgttttcatgccctgcaaggtactgaaccgtcttaggattcactcccgcatagagaagattggtaatgtaagtgtgccgcagctgatgtggtgtcacatcaaaatctatcgtgtatttgattttgggttggttcttctgtgtcatgcccagcgttggagtaaccgtatatttgatactctccccatttacatacttatagtagttccggggcttagtggaacggacaactacatactgccataccctctgaaactgtgaatatgcaagcggctctcctttgctgtcagcgatcacataatctgatatagaattttctttcgcttctcgcagacaatctaccaagcacttcggtatcggaatatccctttttgctgccggggtctttagcaccgtagaaaccacgggtctgttatgctctgaccgccatgctctccgcacggatatatacggagtaggtgcatccagaaacacacaatcccagtgcaatccaagtgcctcctcccggcgaagcccagaatacaagcaaatcataatgaacaaatagggtggcagccccttgactgtatccaataacacctcaacctgctggtcggttaatgcgtctttcttcttcgttggctttccgccctttgcagatattcctacacagggattataagtgatcagctcactacgctctgccgagtaaaaaatacatttaatgagcatatttaccgtattgtataacccctccgatttgttggtcagcggcacaagcgccagacgaatatcatctgcggttacttcctccatatacatatcccccaaaggcttaatgatataattcctcatgtcagaggtatatgctttcatcgtagctgaagatacctttgctgattgcatcagcagccatttctcacaatattcagcaaccgtcggatgctttcggcgaaaaacaatctcctcgacctgcttttttgctgcctgctgtttttcatatagttcttcacaagtggtcgcatacaagctgacctgcttgccatccgcatcctgaatccgtgttctgtaatataggattccttttctcataacagttccgtactgcggaacacttctatttttctttgccatatagtttttcctttcttgataatgagcgtttacaacttacactctcgttttatcagaaagcatgaatttaatcaaagatacggattgaggaaaatgaagagcgagacatccttgcctcgctcttaactaattatgatgtttcattgcttctgcactttaggctcaaacaccatcccactgagcaaatgcaccgcccatgcttttaaccagctcatccggtcgattgtatttgacttttgcatagatgtccattgtaatcttgctgctctcatggcctgccaagtattgtactgttttggggtctaccgatgaatgaatcaggttcgtgatatatgtatgccggagctgatggggtgttacctcaaagtccaagctgtaaaccacttttccgttatgagcagccttttctcccaagacgggtgtgacagtatgctttactcttttcccatcttcgtatcggtaataaaccctctcctttgttgttctggtaactatatactgccagagccgcttgaactgcgtgtaggacagcggatcgccatcacgatttggaacaacatactccgaagcggagtttgcttttgcttctctcaggcagtcagccaagcagatagggagaggaatatttctctccgctgcttttgttttcaattcatcaagaatgaccggtcggttgctttctgtgtgccatgcccttcgtactgtcaggtatggggtatccgtatccagatatacagaatcccattgcagggcgaggatttcttctctccgtaagcccgcgtacagaccaagcatcacaaatacatacggcggaagcccttgaatggcatccaataagcgggctgcctgctcatctgtcagagcttctttttctttctgcggaacccctccgccttttgaggtcagatagaccgtgggattcttatcaatgatccggctttcctttgctgcccggaaaatagatttgtaaagaacaaccacagacttataaaccgaagccgatttttttgaaacaggaacgagggcaagctggatgtcatccaaagtcacatccgccatccccatatcacccaactctttgataatgtgccttctaactttagatgtatagtcagtcattgtggtagcccgcacatgaaccgactgcatcagcagccatttctcacagtattctgctacggtaggagacttccgacaaaatgtatcattgtcgatctgctccaacgcattcagttccttatcatataattcttcaggtgtccttgcataaagagccctcaattttccatctgcatcctgaactcttgtcctgtaatagtcaagaccgttcagcgtaactgtaccgtattgtggaatcgctcgttttctatttgccaattcctccacctcctaagaataatctccagcgctgtacctttgttttatcagacctctctgattccgtcaaggatacggatcggctcacgatcttccgcttcgaggcttacggtaagttgtgcttctctcaactggctttgctctatgcgtacatttggcgatatactcctggagacctgccgcagtaaaatatacacagccattctgaacatattgcacataagagatcaagccgttgttacgggcggcatccagcgttgctatgctgattcctaagatttcagcagcttcttttcgtgtaatgagtttttccatagaccatattccctccaatctgtcaaggttatcatcttgctttcaaaaccacatgaatacgctggcaaccgaaactgccagcgcatggtatctgattttgaatagaaaacggccacctaagaaagtaatcgcttcctatttttaatgcaactcaattctcgccacatttgccacgcacccctgacgatggggacattccggtctccgctggcgcggctgtcataactccgcagcgtcgttttactcgtgcgccgcagggttccccccaagtctttaggaggccgtgaggaagtatctttaagcccccatgcagtcatcgcgccccgaaatgccgctttcgggtttcaggcttgcgtagattgctcagaacagtcttgttcatcacctcctggactgtcatcttcgcggcgcgcctgattcgctcgtacatgggttatgtaccggaaatgccgtctattcagttgtcaagctgcatgagggagatagaccctctcacttacttccccgttgggagagcagtttagcaaccgattttagaaaaattcttcaaaaatttttctcagcttcaacagtagaacccgttttctcttattgaccgcctgatgcgaaatgtgcaatatattcccgacttcctgttctgtcttttcttgatagaaaagcaggaaaatcagttcttgttcgtcttcgtttaattgagccaaacaaaagcgtatctgttccgcttccagatgttccaatgcaagctgttctacgttttttccgggcgcagcaaactgcctgtccttttccaacagacgctcataggaatcctctctgctgggcaggaaagatgcagtgtctttctggaacttttccgttttcagatcgtaggaaaagtattcttcttttcgctcgtagtgctgatacacgcggtaaatctgttcgcttaccggtacagcctgtccatctatataaagataataattcgctctttcttcacgatttttgctcacagccgttacctccaagagtttgaaaagtggatcgttttcgaactctcggaaggcggcgaacggcagcgtgggaataagggaaaaataatacggacacaggcacaggaatatcccatgtcggtgtccgttctgttttgtcgctttctaattgctactaatagttcccataaaggccataaaagactggcagggaagaagcgggaattttggggttctggcgtagttttacaaccaggttttcttcgttaagaggacctgccagaagcggacaggtcattattttcccacataatcatctcctcctaagcaaaaaaacaacgcatagtagctataaaaaagccactcttcaatcatttcgcataatacttttaccccgtaaaatataattatgtgaggtgacggagagtgaacaaaaaaatgcgacatatagatttttcgtttggggcatccttacggaatgccagggaaaagcgaaactacaggagagaacagattgcggaacgtgcagaaatcagtcctcgttttttggcggccatagaaagcggccggcgaaagcctagcttggatgtcctgattcgtcttgtcaatgccatcggcgcttcgtttgacgaaatccttgcgccgcagatgatcacagacagcgaaatcgttgatcggattaggcgcttggtcccacaatgcagtcagcgagatcaggagctgttgctcgccctgattgataaaatgctggatacaaaagagaagaaagataacaaataatgcggtcgggtgtattgcccagccgcattatctgtccgttgctatacgggcaaactgtttttccttttgagaggaatagtaatccctgagtttctcaaaggcttctatactgatagtatgttccatatggcaagcatcggcctccgctgtcttaggattaacgcctgcggttattaactgctccatgaagaattaatggcactcatagattttttcgggcaccccgcagccaatatctgctagatgtaggtatgctcctttgcatactgatacaaaactactttaaagaaaaacaatattgacagcattcttccataaactccggatcatgtgtgataacaatcacggtttttccgcggctggcagcggctttcaatgcatcggatattctcctcatgtttgcgccatccaatccacttgtaggttcatccaacaagagtatctcacgctccgaaaatatagcgcaggcaacggcaagtctctgtttctgtccccctgacagggctgccggatgtacatcccgatactcgtacagattcatgttctttaacaactgccttgccctttccattcgctcctctgacaacggttgattcaagagcagctcttctgaaacacttgcggtaaagaactgtgttgtcgtgtcattgccgcagtagtatactttttttcgccttctagacagatgatttttactcccacaaacgatgatgtcaccgccgctcttcttagagagacctgcaagcactaaagccagagtgctttttccggcgccatttcgcccggtgacagcagtgatagaaccttgggggaaagctcctgaaagatttgtaaacacctctatttctccgcattttttacacaggtcgtgcataatcagcgacccacgctcgaaaagtttcggaagtggtagcggttcgcgtgtttgtacacggtgcatcgtccgaagccccttgttgcgccgttccatttccggcatagctgtgaactccttgggagtgtattcgcgtacaatcctccctttttccatatatataatccgatcagcaagctcagaaagccatgagagacggtgctctgcgatcactaacgtgtagccctgggctttcaacttaaaaagcgttcccaatagttgctcgatcccccctaaatccaaattcgcagttggttcatcacaaacgaatactttggggcgcatggcatagacggaagcgattgccacgcgctgcttttctccgctggaaagcacatccagaggtctttttcttattaaggaaagagaaaaggtttcaatggatttatccgtcctctcttgaattgcctcccgggagaagccgtggttttcgcatccaaaggccacctcacccacaagttctgatgaaaaaaactggcttttaggattctggaatacacttccgacgattgttccgatttcccaggctgtcatccctgtaatgtctctatcatctatacaaatacttccggaaatggagcctttgaaataggatggagccagaccgttcatcaatctggtcagagtcgttttcccgcagccggacactcctgtgagtaccacacattctccctgtgctatggatagatttacgttccaaatttgctgttcgctcccctcatattgaaaggatacgttcttaaattcgatcaaattttcacacctccaacgcaaagaactgctgctgtaacgattccccaaagcgcaaggaaacaccagtcgcgcatatgcatcgttgtttcgtagtaactctttcgcacgccagggcactcagcgcctcttgccacagcggaaacggccagttggtcggcaatctgcaaaatacgtagcagaagtgggacaaggacatattcaacacttgcaagtggatgtactgcaaattgtcttacagatgtaaggccccggtttttcatcgaaaggcccactgctttaagctcagccttcatggtggggaaaaatcgaaatatgaccatcagtcccaatatgacgccagtgggcatgtggatacttgacaagaacgacgacagttctccaggaggcgtcataaacaaatcccaaaacagcatgagcattaccatactgctccagaaaaacaacacaaggaattcggaaataatgaccgtatgatatccccagaaccgaatcgcgtacaaaagcaatgacaacagcagataaaaggctccacaggatgtcattaatcggtagtttctctggaatccaacatacacgaagcagaatatcaccaaaacggtggtaaacagaatgtttttcaccagaaaaatacctagcatggcgcagagcaatgcaaaaaacttggtcgggacagcaaaggagtgctcacctctcatagaacacccgctttcttgaagtgtttcccaatcagccgactcccaagtatactgcctaaaaagccacagataacagagaaagatacaataaagatcagccagccgggggaggtgtaatattgtatgtaactgtcaatatagctttgatccatgccgcttgcgacggcaaacgcgtaaaaagtgtcccagaaaaacaaaagcggaagaagattgcctccattataaaacaggctcaccatcgcccatgcgaaggttaatctctttgcgttgcgacaggatccccgcttccatagtaccacctcgcatagtaggcctaccaaaacgaaataagttgcctgtcagcaaaaaaaacacgcccagaatcgtcagatacgtcaaagaaacgaatcttttatttaccctgctgaccatcagcatgtacaccggggcagagaaaaacattgataccccaggagataaaacgcagttgaaaaattgatttaccatagagacagtaataactacaaaatgaatgccgatgagaagcaccgtcaataatactgttgtaatcacatccttgactgtccatttgttgtttgttttcatatgattttcctttcttcattatgaatgagaggacaaggcgcgccaggaatgacggtcaccccgttccctttacgttaatactggaattcttccgtcagttttgctttctccaccaaattgttataggttggagaagctttaagcagttcaagatgagtaccggacgcctccactctcccgcagtcaatcaccacgattctatctgcattttcaacggatttgagacggtgggaaataatgataacggtcttatccagaatgaggcggttcaaactgtcctggatctttttttcgttttccacatccaaagaggctgcaatctcatccagaatgataataggtgaatctttcaaaaaggctctggcgatggataaccgttgacgttctcctccagagagtgttgctccattttctccaatcatcgttttatacccatccggaagcctccggataaattcttcgcagttggccaatcgtgctgcctgaacgacttcctcatctgtggccgtctttttcccaatacggatattttccagaacagatgcattaaacagcgttacatcctggaacacgatggctatcttttcaaacaaggattttgtagagatttctttgatatccagcccgccgattcgaatgcttccgccgtcataatcataaagtcttgacatcagacgcaagatactggtttttccacaaccggatacccctactaaggcagtcacctcgttttgcttcgcggtgaaactgatgttcttgagcacttccgtatccttatcgtaagaaaaagacacctgatcaaattcaatatcataacttgagattgtctgatccttgccctgctgtatctttgtctcccgcacctcccggatacgtttgaccatggaatccagataatacagctctgccacattcatgctgaccgcttctacgctttcccgcaccttaatggaggccagtacatatcctaaaaagtacaggatattgatctctcctgtatgcagcatttggacgcctatcaggatcacaagcacaaaggcaaattgcagaatgacattcgagcacaacataggaatacccgctgaaatctctgcacgaagatggattttctcactttcttccatcttttgataaagagtctgccggatcttctgagtcaagccaaagctcttgatttcctgctgattttcaatggcctcctgaaagctctcagagttgtcccggagcttttgataatgtttgaatgactcccgaatctgaaggtttttcgacaataaaagaagcccgaatccaagcagaattggcagaatgatagcaagccccaatttaacattgccaaggagcagcagaaccgaaagcaacggaaaaaagaacaggaatcccactgcctttgccatagcgtggctcatagcatgctcaatagctgccacatccgccatgatggtttgcgccagatccgaaaggtcatgcctggaaaagtaggataagggcaacttggtcagaatatctgcaatctccgtgcgaagattcgcgctctcctgataagtggtgttatacagcgcatcatattcaattcggagcagaatccacatcacagccagaaccaggatagatccccacaaatacagccctgtttccttgacattgttcaacagcaactcatccaccaagagaagcagcagcattgcagggaaaaagttgatcacatagacgaagaaggaggccgcgctggccttttgcaaatctttggcccccttgtcggtcagggcaaaatgcgttttaaacagttctctcatcttacaaccctccattcatttgcctgttcatagagcgtttgatattctctgtacttggtatcggtcgccatcaacgctgcgtccgttcctcgctctgctattttcccgtcctccaaaaccagaatttcatccacatttcgaatgctggacagccggtgtgcaatcataatgacagtctttcccttcattaagtgagcaaacgccttttgcagctcatgctcattctccggatcgattgccgcgctggcctcgtcaaggatcacgattttcgcattctttagcattgcccgtgcgattgcaatccgctgcttctcaccgcccgacaggtatacgcctttggagccaatcaccgtattttcccgatccttaaacttatccagaatgctgtcgcaacctgcctgatgcagcgcttccatgacctccgctctttgagcgtctgggttcgccagacggacattctcgtaaatactgatgtgaaacaaacggacattctggaacacaaaggcgatattgcggattaaggcgtcctctgtataggcttcaatgggctctcccccaatcttgaccgctcctccatccactttgtaaaaaccagaaatcaatttggcaatcgtggactttcctcctccagaagatcccaccagagcatagctcctgccttctttcagagtgaagctaacatcctccagcaccatctggtctgtatacccaaagcatacccgttcaaattcaatgtcatagtttttgaatgtgctcttgttcccaaatgtaagccgatccttttgcatatctgaaaacacctgctccagtttttcaaccgccgaagttcccatgaatgcatacatacctacatacatcactttcataaaggcggtaaacattactccaccaaggaataacgtcataatgagttccaccgccaacacggcagggtcttgcatccgattcagcgttaaggctgccactgaaacgagtacggcaataaagccgaatagaatcagctggaataacacatatggtctgcggcagctcatggaatagttcaaggcatgccgtgcataatccgcgattgcccgatgcagcgtcttgaaagatgtagcgtctatgccaaaaatcttgagcacctgtatcccgcgtatgtactccacggtctcgctgctcattgtctccagcgccttttggtagacttccataaacttcttttccccggtcatcaggacaaggagcacgccactcagtaggaacagaaccaatagaacaatgcctacccgcagactgatcaaaaaccccaccacaagcgccaaaaacggtgtcagaattgctccagcattgtcaggaatcagatgggctacaatagaatgcgtttgggccgcgttgtcatcaatgagtttacgtgtctttcccgatgagttcagatcaaagtagcggaagctggcattggtcaggccgtcaatcccacgcttgcgcaagttggtctccagccggaagcccaacatatgcgtcaaaagcacggctgcaaaatacaagagcgaaccgccaatcaacagccccgcaaccagaaacgcattatattgagcatgccccatatctccgtctaccaccaatcgtttcaaaaactcatagaggtagtaataagcgcctacattgagcaatgtggacaccaccgtcaggccgattgcaatataggccaaaggtcgctgcttgggcacataatagagcagttttttgtatactgcaaacatagacaaaactcctttcataccgtgtgatcagatttgattaaaagcaagttagcacgagctaacccttgcgcgttattatatttcttcgcaacgtccaaagaggaacttatgtttttaaaattatttcttgcacttcaggataaattcttaattctctttcgcaacaggttttccctcatcttattcccatgatcaaacagggatttcaaacagacgaaataaacaccatgctaatcaataaaagaaattctagacgctgattcattgatttcatctatattctcattgatagtctgagtcgatgcaggaacacataactgacttttcaattcaggtttgtaatttgcattttgatcaggatgtatgctccaaggtgtaatagttcctgtgagtgccaaaagtttttctaagcttgtttcaattgaaaagttgttggattgcatccaagcatcatcaagtaaagtttgaatgtaacgatcccctccatcagaaataatgcacacgacacaatcgtgcggagaaagctgtttagtgattgttaatgcgaccaaagcgcaagctccgccggacggccccatcaaaacaccttcatttctggcaaagcatcttgctgctacaaaagccgcctcatcagtgaccttatacacagaatcgatattctcgactgcaacattgcacggtgtccatgccagtccaataccaggaatcagatatgagtgtgactcaccgccaaaaatagaggacccaacagcatcaacaccgatcacttttacgtccggcctatatgttttcgtgtatcgtgaaatcccacccagttgtccgccagtgcttactgcggccacaatagctgcgacattatctgggcaatcagcaaagatttcacgtgctgttccttggtaatgcgcagtgctgtttaacaggttgaagcactgatctggacgaaatgcatcagggatttcactggccaatttattcgcaagagaaatccttgttttgtgataactgccggaatcatcttgttctgttacaacaataacctctgcgccaaagcatttcaggagagctaagttagtcgcagtggttttaggatcgaccagaataataactcgataccccttagcagctcctatcatcgccaaggatattccgaagtttccacttgaggattctataatggttcccccgggttttaataatcctcgtttttcagcttctgtcacaatgaacaacgccggcctgtcttttatgcttcctcccggattaccacgctcatatttaaacagaagtcgtccttccgtagaagcggtagtgtttctaagttcaatcagcggagtatttcctattgtttccagcaaatgcattctatcaccaccttatttattatttgctcttttaggctgtacatcgaaaactacccatttataccagcctgctaaattatgatacctctgctatgtgtagttcgctgctcaacaggcagtgtgtaaactcgttttccgactgagcggctaacctgtctgtcgaaaccatatctacaaaaaccccattgttcataattgcaactctttcacaggaatgacggatgactcttgcgtcatgggaaatcataatatatgcaaagccaatggatttttggagatttaacaggagatccaaaatctgcttttgcagtatcatatccagtgccgatacggcttcatcgcaaattagaagctcaggctccacaataagggcacgggcgatagcaatcctttggcactgccccgtgctgagttggggaggacgacggtgcagggcatctccatcaatccctacactctttaaataaaatcgagctttttctgtgcgttccttcgtcgttcctattttcaggtatttcaaaggttcctgcacaagctccagtgcagagcgacgaggattaaggctggctcttgcgtcctgaaaaacgatttgtaatgatttgcaaatgtgttgtctcttccttcctcgcagcatggaaatatcctggccgttatacataatctttccctgatcaggcaattccagtccggtgacgcaccttgctaatgtcgatttcccacaaccgctaaatcccaatattccaatagtttcccctttatgcacaagcaagtctacttggtttaagacgtttttgcacttatttcctttttgaaatgcttttttgatgcactcaatcttcaacagcggctctttgcattttgagcatggcagcgaaaaagcgggtaagtttcgcgcctcaatcagttgttttgtataatgttcctttgggtgtaaaagaacatcctgtactgccccttgttccacaattttcccttcatttaaaacaattacgcggtcacagatttcatgaacgacaccaatatcatgggtaattaaaacaatagataatcccagctttttttgtgtgtcccgaagtaactgcagcacttctttttgacttactgtatctagcgcagaagtaggctcatcggcaataagaacttccggctcaaggctgagtatcatcgcaatataaaccctctggcacatcccgccgcttagctcaaaaggataagcattcagtacccgctcaggatcatcaaagttcagtaaccggagcatatcataacaaactttctccatagcttcttttgatggaaatggcttgtttcttagagtctcctcaaaatgcacacgtattgttttcacgggattaagtgcaagctgtgcgtcctgataaatcatcccaatacgcattccacgtattgttttccaattgatatcattgtcagaaatatccacataatcaccgttcccgaaacggacagtaccactatcaatttttgccgatggcggcaatacgcctatgagcgatttcccacaagtggatttccccgaaccactttctccgagcagagcaagaatctttcctttttccaatacaaaagaaattccgtccagcacgggaagtcgttttttgttttgcacatagctaaccttgagttgctcgacagatagtgcggctttcaaataattatccatagcgacctcctaattcaaaatatcaatatgttcatacgggtccagcatatcccgcaaaccttctccaatcaaattaagcgaaaggaccgtaagaacaatgaacaaagcaggacccaataaaatgtgcggagcctgaaagaaatgtgcccgggcgtcagacagcatgcttccccattccggggttggcggtaacgctcccatgcctaagaatgaaagggccgaaacagagagtatcagtgtgcccaattcaaacgtggccagtaccaatagagaaccaatcatcttggggagcagctcaaaaactcccatccgccacccagacgctcccagcacacgagcagcctgtatagacgggtcattctttacctgaagaacgatgcttcttgccagtctcgcaaacggaacccaccagactgcgactactgcaataagtaaattggccaacccagtgccccacagcgcggcaaacaccatagcaaacaccatgaagggaaacgccatcaggacatctataacccgcattatgatcgtatccaaaaggccgcgacttctcatgccggtgataataccaaagaacgtgcctataaacaacgccattacaagggcaagaaagcacgcagtgagggtagtcctgccgccatacagcgttcggcagaaaatatcacgcccatagcgatccgttccaaagggatgtgaaaagctaaattcctgcaatcgttccgcaattgcttcatcgggcgcatagctggtaaaaagaggggcagcgataacaagcaggataataaccagtaatagtattgagccaagtaaaacagtgcttggaatttttctgtttcccatacaaagtcacctcctattgctgtgcagtagggcgggaaattccgcctctgcgcaccatcgggttgctaagtatataggtgatttctacagtcaggttgatcaaaatgactgtagcaaccgtcaacacagtatatccttgaacagcagggtaatcatgtaccaatatgctgttgattgcgtaatttccaattcccggccaattaaaaatagcttcaatcacaacggagccgcctatcatatgtgcaaaggacagggctacggttgtaatggcagggagcagtgcgttctgaaacgctccctgaagaaccatcttggaggtaagtcctcgtgaaagtgccgaggaaacatataactgacccaactcagtcagcattgctgcacgaaccatgcggatacatctgggcgctccaattatccctagtgtaattgcaggcagccacaatctgccccactccatttggctgctaatttcataccaatgaagccgaacagcaaataaaaacagaaacaacaacgacaacacgaaagcaggaagcgaagcaaggataacacaaaacagacggattgcgcgatcctgtaatttgccggcatggactgccgaatagataccaaacagcacacccaatatcgtttcgataaataatgccgccagagcgagagtgaatgttgcgggcactctactccatagttcctgagtgatgggtctgccgctacgaatagaagtccccatgtccagggttatgatctttttgaaccagtttgcatactgaacaggaatactgtcatttaatccatgcgcttcccgtaaagattctctacgttcttcaagcagttccgtgtttacgccaatatcgcccggcccctctccaagtaccaggttgatcgggtcgcccggagcaagtctaactaataaaaaaataacaactgaggacaggagcagagcaagaagagcactgccaatccttttcagaaccatatttctgatcatcatgtcacctcacttaaaaaatggcagcaggagtccagttccgtatctcctgctgccgttttcgatattatttaatcctaagattggcattcaccacattttcaaactgacggaaatgcgggacaaatccctcaagtgaggtgctaacagcagtgatttgcggccttggtgcaatatagagcgcaggggattgctctgctacgtaaagagaaatctcctcaccgatttttatgcgttcttccgtggttgccgcttgcgccagactctctagcattcctgccaattttttatcctggaatcgtccgtaattggctgcgccgtcggcagcgtattgggcgttcagaagcgccgacacatttccgaacgtcccccatgcttcgacagatgcatcccaatcacccgtttcacgcgctgtggtgattaacgaataatctccgtgttgcacagaaacattaacaccgattttcttccactgcatctgaatggtttcgccgagtgcctgatcgtttcggaaagtacgaagcaggatggtaagctgctgtccatctttgtagcggaagccatcctcgtccagaatccagccagcatcatccaatagctgcgcggacttctccacgttgcaggaatcgtaatacgcattttttactttttcatatgtgggattggaaccaagccatgtagtaaccggctcgcttaatccttccatacccagagcaatcagctcctcacgatctaaagcccaacctaaagcctgacgcacacgataatcattcagtgcctctttttcacagttgagataaattgtctgggtctgcgcacccggaaccagtacaatcttcgcctcttcactgttatcaaactgactataagccgactgaggaatatccattaccacatggtatcgtccactcagtgcagcgatgacacgggcgtccgcatcaccaatctgttcatgtacgaccctctggatctcaggttttgtaccccaatagttttcattcttttcaaaaaccatgcactgtgcaggcttaaactctacaattcggtacataccggtatagtctgctgtctcgatgctctcataagtatatttttctgcggtattatgaatgagcaactgtggggatgacaaattcaaagtaatatccacattaggagtttctgtcacggcctgtatggtctcggaatctaccgcagtaaaatcaatcccttgtaagaaggggttggcttttggatcaagcgcctttgatcgcatcaaggaagcgattacggcttctgcatcggccgggtcgccgctccagaacgtggcattgggatgcagtttgatctcccatgtatattcatcaagttgtgaaacatctttggcaaaatagggttgaatcacaccgtttgcatccgctttgaatagaatttctccagcgcccatattcagcagataatccgccgcaggatatacggtaggatctacgccaatggcaatttcatttcccgcaactaccagttcagatgcagaaatagtagcattactttcagttagagcattgctgctctcatcggtcggttttgcaccgcagccagcaagcattgaaactgccagcaagcagcaaatcataaggatcgatttttgtctatttttcgtaccagtcattttttgcctcctccgtatctattgtttttgtttttctgtttcatcttttggggtgccgaaattcttatacaacataaatccaatcattgccgttcctaccagaacgccatacaagtaccacggcgcattctctagagtgtatttttttgccatatcaaaggacgcgccgccaataatcgttccaaaacctttgccaatcgcaaaagctgtagaattcacccctaaatacattcccaacgctcgtgtatctgccattgatacagcgatattctgctggttcggcctcgccagtatcatgcccactgcgtagcaggccacaattgccataaacgactttacatcggcggcgaacggggtagcaatcaatgccgctgtgatgattccggttccgattactaccgctgcccgagacgagaatcgtttggaagcaagtgctaccagaggatactgtaatactgccatgacaacggcatacaccgtatacataatacccacaccatcagctgagccgtaaatttcctggactcttagggggtatgtaatatcaatctgggacgctcccagccaaaacaccatcatcaaaaggacgaatatttgatatggtctgtcttttgcaattcttttgacagcaggcataaccgcatacgactttgcctgccgcataatcggtggcatggcaacacgtgataatacgaaattaatcataaagcaactcgctgcgccaaagcagacaactttaaaatccagtcgaagcagggctactcccaaaagggggccgattgcgcttgctatccccgtaattgtgttattcagcgaataatatttaggacgattgtcatttgttgtgagcattgcaatcgcagactgatatggcatttcaaaaagaactccgcctaggccgatcaatatcatggcagcaatcagcatcccataggcacttgaaaatgccagtgtcagaaatccaagaactcttagaaatacgcccacgctgataagtgttttgacctgaaaccgatctgccaaggcaccaccgatcatcgcaagaccctgctgcgaaaactgccgtattgcaagcgctactgagacggcagtcgcagtaaggccaacgttgttgacataatgcccgataaccagcggcataatcatatcaaatccaaccaccatgaaaaacgtaaaaaataaaagtatgagcaagccgcggcgttgattgatctgcgtttccacgcttcctaacacctccttactgccttagattgcttttgctattacttgaagcctccgcccacttagttcatatccaaattgaaatggacggatatcagtaaatgaactgatatgaggttccggtttatcgaataactcaacaacctcaaagccatttgctgataacaaccctgctatttcctgcgggaagaaaagacgatgctccaagtgctcaataatcgcctcacgagttccaattttccaattatagtcacgttttaaaatctgttttgctaaatcaatgtaaaagcgtgtttttacaattgctggtttaccatcgaatatcgcttcctccaaaagctcgtccgtcaaccatctctgtccctcctttgttaagaaaaaagctgcattcctcatatcaagatacaaaatgccgccatctttaagatgctttcggaaattcgtcagagtagaaccagcatcttcgttggtgtagttatacaggaaggtgctcccaacgcaaaccagagcatcaaatgtctggtttaggtcaaacattgcctgttgcccaatataaaaattggcgtttggatagtgcttttgtgaccaggcaaccatatcttccgaagcatctatgcctacagcatcgtatcctttttctcttagaaaagctacttctctccccaaacccgatccaacatccaataccttttttcctgtttcgtatttttggagtatcgcgtgtataaaacgcgccatttcaaaagacttatcgttttcaaacacagcatacagttccggattggagtgcagcaagttgtcggtatttgtttttaaacgaatcaattctagtcaccttatcctttgtagcaaaaaacacgggtcgcgtttgcactgaattgcgaaaaaggaaacgattccgctaagagagaggtgattccgttgcccacaaacctcgcagcaacagcactgccagtttgcgcataaacagtcagcggaatattgcgctccagtacccgttctacgactcgatcaaaggttccgttgcttagggtcattcctgtacagattaccccgtctgcagaatccaatactttttccatatccttttctacggggtcgccccattgtgttctttccatttgcaaatcgcagggaaggcaggttcctccgcgctttcgtattgcagctataagcgggtttacaaccccaatcaacgcaatcctcatgccctgttctatgttggcaatatcagcaatcaggttgtcacgaaaatccgctttctcggccggggttccccccggtagttccacagcatcgctgcattgcctttcgtgaggatatactgtgccaagataagcgtccattgctgcaattctaaccggcaaacgcgggtcaatcacgcagcttttgagagacttgcctgaaaactctcttcctgcttcaatgcctaattgctccggcacatgagagcatgctccaaagtatgtcccgactctcagtaatagataatagttgtggtatttattaatggagtttggaaattgcgttgtctgataaatataagacgctcctgttacgaaaaaatcagaaacagagggatccatatctccattcacgatagcaccccataattcattaacatttttatattgcttcatgtactcgctccgtttcctcaaactcaatttccaaccttctcaatgcagtttcagcgaacatgcgagcgccgtacccatcgcaatctcgcgttataacgtgtcccaaatagcaggcattgtcgattggtttttcaatggatttacccacacagtcctcgattctataccgtatgatatttgaatcttcccttaacgtgtcagcgcccttaatctgccttatcttgccgccgcaatccggaacaataaacataatcgcagcactgctcacgttggtatcagatacagtaacggacggttgctgtcctaaagcaagggatacaaaggctttaagcatatttacgccggtcacatattcaatgagttccacgatatagtttcctgctgtacgagggttgatttccaccactttgggaccatccttcgtgagttttatctctgtgtgagcgattccgtggtcatatcctgttgccagcaatacattgcgcacataatcgcctatctcctctttcacgtcctcatccagttttgccgggaacatatgtccgttttctataaagtacggactgccagtcacagacttgtccgtaatacctacaacggtaatctcaccgttatttgaaaccgtctccacactgacttcttctccgcatatatattcttcaatcaaaaatgctcgctctctttcttgatcacggaaattaagcgggaaattctccaaatcacgatatgcctgttgcagatcatttgaagtctgaataagtttaacaaatgcgcttgaggctaaatccacaggtttaagaacaagaggataacctatttcttgcgctgccttttcaacttcctcccaattataagcaagcatgtactttggattggacaatccagcacgatctacagcctgccgcattaaatgtttctgtcgtgcggtcttaacgttggctgaaaacggacacggtacattgtaagcctttgcaacttcacaaaccgtttcgatgtaataatcacacaccgttatcacaccatcgaaccgcacgtgcctaaccgattcgatcagctgttgcagatcgttcgtttctgtttcgacaacatcgtcagcataacggaaaacagcgtgcttttccgagctcatcggattttgataatgtgatgccttccgggttacaaaagtatagctatgtccgagttccctcaataaaggtggtaagaggtttccgcttgctccgacccagctttcaatcataagcaaatgtgccattgctattcctccatttcttttaatagagagcatcatagtcaatgtggttatgacgctcctattgacatattgtagttcttgccatataatttgtccaacgaatagtttttacaaacttaatcggaattattgatagcgtggaggagtacatgaatatagattacctgagaacatttctaacacttgcggagaatggaagcttctccgaaacggcgaaagagcacattgtagtccagtccacggtcagcagccgaatacaggaactggaaaaagagttggggcagagtctttttattcgtagctacaaccacgccgaacttactttagcagggcaggcctttctggaatatgcaaaaaacatagtggaattagagaacagagcaattgatagaattggcttggttggtcagttttctgagcgattgacaatcggaacggtttatgctttccacaagtgttatctggtgcaaggaaccagacgttttttggaaaagcatagtgacatttctgttcgcatagagttcgggcattcaagacatattatttctgctatgcaccaaggaaagattgatataggctattcacatcacccgtttaggcataccggtttccagtgtgatcttgtgtgtgaagatgaaatcatacttgttaccagtaaacaacctactgatctaaatgaatgcataacactgaaagacatggaaacgctgcgcatctacaattcaaatttcctatatgcggatacacataacaggattttttcaagatacaaggcatttcagctcgatatagatataggggaaaatatcgttccatacttattgaatgatgacggctatgcctttgtgccgcgaaagatggtggagcaggaattgtccaacgaatcattgtttgaggttacaattttgaatgaagagataccttcaatgaagaactacgtaatttataaacctacttccccaaaacgaaaactgatacagcaatggctgaacgaagttgtttcggattaaaagggttgttggccgtaatgataaacagggagagatagctctttgagccgtctctcccttgtgttattgccattctaagcttgttgagaatagaggagccaaattctatggaactgacttcctctccaacccatagcttatcggcagaatccacgccagtgtaacggaatttctcttgtggagacttacataaaaggaggatggagctataaatagtcttatcctcaaacaactgtgcatccccaaaatcatcaaggcttaccaagtatcggccttttgcaattaagcttcgcagatgttctcctgcaccaactttgaaaaatttgtttgggacaatataacaaatgtagcctgcatcctttgtttttctgatagcctgctcaacaaaaataaagtacttatcaaattgcttgtagtacttgtcccgaattcggggtaaatctggcaagcaatgccggtgttaatacactcggcccgcagagggaaaaatcctgccgtgattttcccctccgctttgcttgcctggggcagcgcccccaaacccccttgaacgcagaatttcattctgcggctgcgcgttctgcgaacgctttggaccatgaccggcttaccgctggccgtggtctttttcctgttcttttttctgttcctcatccattttcagcagccggtccacattggctttggccgtcaaaagctcccgcatttcttcacgggagcgccggtactcggcgtaggttttcttcttttcttccagcagcttggcatactcggcttgcaggtccttgaccttgggcagcttcttcacacccatctcgtcaaaggcgttttttgccgcctgatgaagcaggatttcttcttcatgttcctcgcggaatttcttggagtaaccagctttccggtaggccacataggtctcgcgggtcttggcataatttacgatgtgggtacgcaggacagcaatctccgccatgcgcttttccgctgccttgatctgcgccgacagttcgttgtggtgggcggtggctgccgccgctttttctgccagttccgcatagtccagcagatgatgttcggtaagaaaatttacagtctgcgccatctgtttcaggttaaaaaccttggcccagcgcgcatacccagcgcctttcccagcctgtaattttgcctgaatgtccaccagcagattgaccttgggcggctccggctgcacgatggatttcttacggggcgtatgctgtttttctccggccagtaccgcacggatttctgcttcactgtacccggcccccagcttgtcatccatacgggctacattcttccagccgggtgctttgagacggatcgctttcccgcgccgggatacttcgcagcccatttccgaaagcagcttcagcagcgcatcaaagtctgccggtttctgctccagcgcacggtcaatcatcacccgcagctgctcccgatgggagggcttggcctgatcgcccagccacttgttgtagctttttccgtggggctttggattctccacaatggacagtccgttctcgatacagatggtgtcgctcaagcgccggacggctctggtgctgccccaaaagttgcggaactttcggtcacaatccatattgaccgccgaccagatgatgtgattatgaatgtgcgatttgtctatgtgagtgcagaccacaaaggcatgattacctttggtgaaccgcatggcaaactccacgcccagccggtttgcttcctccggggtaatttctccgggtttgaatgactggcgcacatggtaagcgatcacatcgtccgccccgcgcacccgcccggtggcggcgatatactgccgcttcgcaagcagaaactctgcatcggcagtccggctgtcacagccatagccggtaattagttttccgttgtcggtcttttgcggatttgccacataatcaatgatgtcgctgactgcctgactttcggtgcggcccttgccgatatgcaacggcatgatgcgtgtggttgccatagggggggaacctcctttccaaaaagaaaaggacagctgtgtgagctgtcctttggttaatctgaattttcaacaggctgctgtgcttttaaggctgcaatccgtttggtgtccacaaaatgagttgcataccatttctcaatttccgagtttccgcttttgctgaaccgcagcggaatcaccggcttgtgtccctgcccatttttcttttttacaccccattgcttgtagtaacagaaggagggttttaagccggttttctgtgcgtacacccgcatctggtgcatgatgaatgagagtttgcgcagattgacggtgcagacccgttccaaatagtccacccgtccaaaccgccagtcctcatatttctgctttggcaggacaccgacctccatcagcacatccaccggagccgcataaccacggcgctggcattgatgatagaccgctgaatgtacttttccaatcagttctttttcagtcatggcggttgtctttcttttcgtgccagtttttcaagacagcctctacctgagcaatcagctgttccttatccggcatatagagaacataccgggatgcgaagatattgttggacagaccgcccagggcatattctgccgcgatgctgtctttttccgtacagaggataataccgataggagggttatcgtcagggtcgttgacttccgccgcatagtagtttaagtacatattgagctgaccggcagcctctggtgtcagttttttcgttttcagttcaatcagcacataagcgcggaggattttgttataaaacaccatgtccacatagtagtgggtattgttcagggtcacacgctgctgggttccgacaaacatgaagcctcgtccaagttccaaaagaaacttttcaatctgtgccacaagagccttttccaaatcgctttccaacatgggtttgttctccggcacacccaaaaactcgaacacatagggatcacggatgatgtcagctggctggctgatctcaacccctttctgagccaaagaaagaaccttttctttattcacatcttcactggaaagcagcagccgttcatacagcgagctgtcaatctgccgtttcaactcccgaactgaccagcccgaattgacagattccttctcataaaagctgcgcttgttctcatcggtaatactcaaaagctcgcagtaatgggaccaggacaatttgccagacactgtctggcatttttcataggcaagataaaatgcccgcatattttgtagattagaacgagaaaagcctttgccgaattcccgtgttagttctttggaaagttcctttaaggtttgttttccatagtctgcgcgaatctgattttgctgttcatactccacgataatccggccaatgttccagtaggttgtcaaaagctgcgtattaacctgctgtgcaacattttttctggcgttttccagcagctctcggatttccaaaatcatggagttgtttggcgttaattgattttccatacacgccctcctttatctaaaactatccgcactcggcggcagaatatattcttatatagtatatcctattttttagggaaagtaaaataacatcagtgacatattttatccataaaccaaatcctgaatggcaaacttcaaatcctgcaccttgcccagcagccagatggcagccatcggcagaccaaacgggctaataaggaatgccatcaccagcaggataatgccgttttgcagggagtaggtaatcagaaccgccacacccagcagggcgatcaccatgctgataagccccagcaccagaccggagatatacacgattcccacacaaatccatacaaacagggtcagtgccaaaatcaccggagccactaaaatctttaacaacagtttcagcaaaaataccaatgccctcattgttatgcctcctcccaaaatcacagttcctgttcctgattccattatccctgtctcacagccaaaaggcaaggatacgggcaaaaagaaaaagcggaggaaggcgcggcgaaaagaacgccgttcctccctccgcagatggggtatttgtcccggttacgaaagtttggagagccgggtcagtatctccttaacgccgtcccatagctgttcctgccgctgagatatatcctccagatcggcatcgtagatacgcccggtctcatgcaccttgcgggtcagttggtttaagttgttgctgctccggcgcagcagggataccagttctttcagttccggcaaatccagctgcaccacatagccgtccacagccatttttcgcagataggcgctcaggttttttgttccaaactgcgccattttctgctgaatcaattccatttcatcagcggatacccaaaacagaaccggcacatctcgcttgcgtttggggctgctcatcgctccggctcccgtttcttcggggcggcaggtttgtgaattgatggttcttgtctgagcttttgcaggacagagcttttctgctgttcctgcatggtttttctggcttgtctggtaaacaggtcggtcagaccgggattgaccccatccacaaccagataggcacagtggcgggaagtaccgctgtcttccggcatgggaatggtttttgcccagactttattgtcctgagaaatacgcccgtcacggttcttgtgctggatggtgttggcaagaataaactgtacccgttccgccccgaacttttccagcacatctttgaccgccgcctccgtatccagccggttctctgcatagtgagcgctgatggtctgctcaatggcttctttgcaggcgctgtttgcctgataagaacggttatattgtgccatctccccatgctgggacgcataggcggcagaatgggggtagagaggggcagtccgtaattcttcctgcgccctgcacgcatcatccgcccggttttcaatgctgtcccggatcgcatccatatagccggtctccagcttttcaaaatagcggtacacatctgccagcggagagggagactccaaaagtgcctgtgcctgtgcatcggtcagctccagttcctccatcgccatcacgatgtcctcacggatggcgtactcataggtgtggtgcagggtttcttccgggggctggcttttcagccagtccctgtacttatcctgttcagcggccatcttttcatagagagccgtattcagatcgttggtattcataatcatcgtacctcctcgtgttgttttggtttcttttcagggctgcggggcggcacagggcgtttcaggctgtccagcaccgagggacgcgcgctcttggcagccactgtttccggctgggcgtggcccttgccgtcaatgttcagtaaggtatccagttccaccagacgggcggacttgatccgcagatcgtcctcaaaggggaacggcttgccaacttcctccttggcagcggcctgctgctggtaaaggttctccagctggtttttgaccgcttccagacgctggggcatctgcgccagtgcgttgtcgatacgggtgagatttccgcgcgggtctgtacccagggtcgcccgatgggtcatttgtcctttcagcaggagcgtatattcctgtttccatgcttcaaattccacagacataatgaatccacggtaactgccaatctgtaccggatcggaggttttgacctccttacaggcatccagcagggctgcaccggcgttttctttgtcggtcagcacatcgccccggatctccataccagcaaagccatctgccgggtgtgggtgggcaaccagtgtttccaaatcgacttcaaagccctggatataccccttgttggtttcgatttcctgggggaagtatttgagcagctggtcctccagacggtactgcttgctctggtggtcggctttcatcagcttcagcttggcaacctcaacatccaaatccatgcgctccttgatacggggatctccggcacacagggccttgatctcagcaaaagaaagagccgtttcatccacatcgtcgcaggagcgaactgggcttttgctggtcatgatttgcgaaatgaatttctgcttgttttccactgtctgccagagataagcgtcaaaagtcccctcggtgacatagcggtacacatgaaccagcggattctggttgccctgacgctcgatgcgccccttgcgctgggcaaggtctcccggacgccacggacaatccaggtcatggagggctacaaggcgatcctgcacattggtgccagcgcccatcttggcagtgctgcctaagaggacgcgcacctgcccggtgcggaccttggagaacagttcctttttccgtacctctgtgttggcttcgtggataaaggcgatctggtcggcaggcatcccctgggcgatgagcttttggcggatgtcctcatagatggtaaaggcaggctccggctcatccagtgggattgcttcttccaacccatgaagcagcggattgtccagctgtttggctgcctttttggagggggctgcctggggtgtggaaatgtcgcagaataccagctgggtcagcttatctgcgtccccgtcccgccagatctgcatgatgttgtccacgcactgattgaccttggtgccgggttcatccggcagtagctggttgatgatgcgctggtccagtcccagcttgcggccatccgaggtgattttgagcatattatccacggacgggtccacacttcctctgtgtacttcggaagcgcgctcggagagtgccttcaccatttcctgctgatgttcggtgggctgtgccacaatattgtggtattccacctccggggtgggcaggttcagctggtcggcggtcttgatgtccgccacctctttgaacaggttcatcagctctggcaggttgaaaaacttggagaatcgggtgcgcgcccgatagccggttccctccggggccagttccagcgccgtgacggtttctccgaaacggctggcccagcagtcgaaatgggtcatgttcagttcttgcaggcggtcatactggagataccgctgcatggtgtaaagctcggtcatggagttgctgaccggggttccggtggcaaagataacgccacggtttccggtaatctcgtccatatagcgacacttcgcaaacatatcgctggacttttgggcatcgctggtggagagacctgccacattccgcattttggtgtataaaaacaggtttttgtagttatgcgcttcatcgacgaataggcggtccacgcccagctgctcgaatgtcactacatcgtccttgcggctctcggcctgcaatttttccagcctggcttccagcgatttgcgggtgcgttccagctgcttgaccgtaaaacgctcaccgccgctggcctgtacctcggcaatcccctccgtgatttcatcaatctgctcatataggagccgttcctgacgctcccggctgatggggattttctcaaactgcgaatgtcccatgatgatagcgtcatagtcaccggtggcgatccgggcgcagaacttcttgcggttgtgggtctcaaagtcctttttcgtggtcacaaggatattggcggagggatagagccgcagaaactccgaagcccactgctcggtcaggtggttcggcacaacaaagagggatttctggcacagccccagacgcttactctccatggcggcagccaccatttcaaaggttttgccagcgcctacctcgtgcgccagcagcgtattgccgccgtacagcacatgagcgatagcgtttttctggtgttcccgcaaggtgatggccgggttcatgccgccgaaagtaatgtgtccgccgtcgtattcacggggacgggtggagttcatttcctcattgtactggcggaccagagcttggcggcggtccgggtctttccaaatccagtctttgaaagcgtcccggatcgcttgctgcttttgggcggccagggtggtctctttggcattcaacacccggcgctccctgccgtccgcgtcctccaccgtgtcgtagatacggacatcacgtaggttcaggctgtcctccagaatcttgtaggcgttggcgcggctggttccataggtggtataggccgccacattgttctggcttatggagcttttgccagtgatctgccactctgctgtaaatggggtgtagttgacctcaatattccgctgcatataaaacggggtatcaaaggtctcgtacataaactgctggatgtactctttgtcgatccatgttgcacccaggcgcacctcaatttccgaagcgtccaggtctttgggctgggcggcggtaagggcttccacattggcggcgaaggatgggtcctgctgtgcggcccgctgtgcctgacgcagcttgcggcgcacattgccggacaggtattcgtcagcggtcacataatggggtgtgccatctttctccacttgtcccggtacacggaagatcacgccttgcagctcggcagccagttcgtcgctggtcttaccggtcagctccgacatatatgccatatccacacaggctctctccgcgatggaaacggcaagggcttcactggcggtatccacggtttccaccgccttgtggggcttgatggtccgtttggtgaacatatctgccttgcgctccagcttgccgtcctcgtcaatgacttccagcgcgcagagcagatagtagctggaatcatcggcaaaggccagccggttcgcccggtcattgatcaggccatattttgcggaaaagctgtcatagagccggttcagttcggcctgtttatcccggatggcgctgtccggtgtggcagcgtccatttgcaggtcaatgagctgctggacacattctcgcagccccaccagcccttgcacgcgggcctcggcggtggcattcaggtctgggcgtaccatgcggctgttttcacggaaatacacatcgccgtccaccacggtataggagtagtttttcacattggggtcggcggggatggaggtgtcgatggcttcgccctcacccagctccggcagatcggcttcctgataagtgccgcgaatgtgcttcaccgcatcgtgcagctgatcggcaagctccagtccctcgatgggattcacggtgtagtccataccatgggcggtgctttccggttcctgtcggcccagcaccatttccgggtggtccaggaaatagcggttgatggcaaaaccgtcctcggtctgtccggtctgcgtccattccggcacgatgtccagtggacggtcccgcttttgcaggaagatgatgtctgaaaccacctcggcaccggcgttctttttgaaagcgtcattgggcagacggatggctcccagcagctcagcacgctgggcaagataccggcgcacggtggaatctttggcgtccatcgtgtagcggctggtgacaaaggccaccacgccgccgggacgcacctggtcgagtgctttggcgaaaaagtagttgtgaatgctgaaattcagcttgtcataggctttgtcccgaacctgatactggccgaaaggcacattaccgatggcgaggtcatagaaatcccgcctgtcggtggtttcaaacccagccacagtgatgtcggccttgggatagagctgttttgcaatccgtccgctgatggaatccagctccacgccatacagacgactgtttcgcattttctccggcagcataccgaagaagttgcccacaccgcaggacggctccagaatgttgccggtctcaaagcccatgcgccccaccgcttcatagatggcctggataaccgtagggctggtgtagtgggcgttcagggtggagcttctggcggcagcatattcctccggggtcagcagctctttcagctgggcatattccgcagcccatgcgggtttctccgggtcaaaggcatcagcaagaccgccccagcccacatagcgggaaaggatttcctgctgctccggcgttgcctgtccggtggtttcttccagatgtttcagcagtttgattgcttcgatattggcctggaacttggctttcggaccgccttcgcccaaatgtgcatcggtaatacggaagttctgtgcattgtggcgcaggttagccttgtattcctcataagaagcttcctcggcagctctggcattggggaaggtctgccactggccgtttaccggaatggaaaccgggtgttcgtccagcacttcctcaaaggttttctccggctctgtcacaggggctggtggctctggctcctcgatatgcagccgttccaccaccacatcataaggcagattgttcttgtcgccaggatagacggccacggtctcggaatggaaggccggggattcggcagacggttggggctgttcctgtccaaagccatccagctgacgggcatacatcccgcgcagcaaaggcgcaacctcatcccagcgaatatacagcacagccagacgcttttcctctgcgtccaggacttccagctccatgccctgtgccgtggtacggtaatcggcaatatcaccggtctccagatccagcgtctcgatctcacggggataggctctgctcagccagtaggcgatctcactgttgctcctgccggattgcagcagcgtggaaacctgttttttatctgcttcatccatcagtccatgggccaatacatcccgcaagtcctgatctgccttgtccgggtcaatgggaagaaactcggtatagtaagcattgcggcggtctgcccgaagcaactgctcgaactgttctttgcgctctgcccggtagatgggatataccatgccggtgggcagaagctgcacggtgtcatcccgcagctcggtgatctgataggcgtcatcctcgatatacacggtatctcccacggcatagaccggggtagcagggtcataggaggttctttgcggaatagggctgcgaacggcgtcatattcctcatcggaaatggaaacctcggaagtctgttctgcctcagcagctgcaatctgctctgcatccgacattactcgctggataaacgggtcattgtccagtttttccgggtctgccacctggccattgacgatccctctttcctccaaggcttcccggatggcgatagggtcgatgttgtcaaaacggtcctgttcttcttcggtatagaacctgtcctcctgaataagctgggcaagcctgcgctgtaccttgggccaaggcagctgcatttcctccgggctgccggcacggacaacaaacaggctgttactgccgccgtattcctgagccagccatgcggcggtgtctttctcccttgcatggtccttcatatagcggacaacggcgtgtttactctcgatattgccgttccatgcacaaagggcagaatcaatatcttcctgagagagaggacgcagcagctcatggagtttgggataggtttcgtctgccacttcccggtgcagccactggcgaaactccggcacatcagagaacaggcggatcagctctatatcgtgggaatcaagaatggtgcggcgcacagcagcattacactcgatcatagcgttttcataatcactatggccgcaggcgttgcggtatctggtgtcctgggtaacagcttccatcacgatgggcttgtatttctcatacagttcccgaatcgtaggggttgcctgttccggctccatatcccggaacactctggttccatctgcgccaaactctgcttcctgagcattgatgtgctgttctgcctcatggtcgatggagagcatggaatactcctgacgctctctgccgccctccgggacagcggaaatagttacatcatgctgatcccgcagatgttctacaacctgctccagccggtttgccggaaagccgcacatttccacacggccaccgccggggatagcgcgggtcgtgagatggaagtccagctccgcagcggcagttttggcatcttcaccatacagttcaaagaaatcgcccatctgatagagaactatgtcatccgagtgacgctccttgaccccgttgtattcccatatctccggggtcggctgctgggcttgcagggcatcttcttcggccagcgctttttctgcctggattttgtcatactgcgcctgttcctgttcagtgagatagcgtcccttttgaatcaggccggtaatccgtttggcaactttctcccatgtgaaatgcatatccgggcagccgtcttttttatagtgcagaccctttccatcgtgatcttcattactgcccatagcgccggacagggcgtgagagtgaccgccgatgccgtactcagatttcaggaaatccaccttttccttatccgtatggggatttttgaaaaaggtgaaaatgcggcccttgccgccctcgataccgctgccgccggtcatggctgcgtcgatctcgtcctctgtgatgaactgcttgaccgcaggaacatcttgcatttcagacgaaaaactcttgcggggcagggacaggtcttgcagactttcccaaatctctctcggtttgtggtaatggaaccgcagcaactcccgatcctgctggtaggccgtccagaaagcagcgtattcttccgcaagggtctggcggaactccgggctattcagctgttcagtaagccatgcggtttcttccgggaacccggtcctctgaataccggacagacaggacagatacccggaatctctggctttatcgctgaaatcgtggtacaaatgccaaagtttttccgcaaggagggagcgttcatagcctgccgcttctgcaagctccacattggaggcaaactggccactctccaaaagctccccgatacgctctgcggcgctctcccaggaaatgaccttggcagacctgtcataacggacagacttcccatgagaaagatggataccatcctcggcataccatgcgctcacgctgccaaggccattgccgccgtgatacagcgttttcagtatctcggcaatctcagcggtggttttctgcttttcaaaggctgcaaccacgcgctctctctggcggtctgtattgccgcccaaacgcagcacatggtcaatatcattttgggcaaaagaaaaagcagaggatgtatgcgctacattctctgcctcatctatagattggatctgttctgcttcggagaggaacaggtttagggtcagctgttgataagctccgccatcaggatctcctctgcctgtgctttgcaggtattcatcagccccacccacttcatgggatcgctggctttcagttgctcggtggctcccgcttctttcgccagctggggcatcatctgctccagtctgctctgggcggtctcgtcgatctccagaaggtgctggtacaacttctcgctcagcagcatctggttgtagaggatgggacggtgttctttcaggtaggttttcctcatcctgccgtacttgcccaggggtttctccggctgctggctcagcttcaggtcgggaatcagatagtctccgttctggatgtaggtcatgggattgttcatcttgcttactcctttcttggttggcttcgcgctctgcatttcggacggtaacgccgatctgccgcagcacctgctggttgatctggctgaccgctgttcccagcgccccgatggtggacggggtattgaaatcaaagatcgccatgaaatcttcgtggtcgaagtagcgttccggctccagtccgcagcgggacatcaatgcgtaagtgatgctgacggtggcggctgccttgaactgcactccgatgttatactcatcatattcctccaaaaaggaaccgtcaacgatgtagaagaagtcctgctgatgctccgtccagtattcctcagccagtttcccggctacctcggtaagttgtccggcaaggtcatcgccggaaacatcataggtacgctccagcatggcctgcacggaatcaagatggcgctcctccagctgccacagccaaggggtacgggaatgttcacgggttccggtgtcggaaatatcgaacacatagcgcaggcggggtctgtccccggaatcatccaccagagcgatccccttggaaccgcgccttacatatcggcccatcttttcattccacaggtcgtactctgcacaggcggtagcgtccgggcgttgggcatagatcagcagctgttcatggaatggatacttgtaaaggcgggcagcggtggtcagaaatcccgcccattcctgccagctgcctgtgagctgggttgccacatggtcggccatctgccggtaaaattctgttttggatggcatggtgttttgtcctcctttcagttttgggtaaaagaaaagcaggaaaccttgaaagatttcctgctgcttatacgtttattacctatttttttgccagaatacagatatgatgttttttgtttttatgatcgatggtgatttctgaaaatcctgcttcagttagaaaaaattctaactgctctacagtataaattttcatgttgtcaatgattttcaaccacttatcatccgctttatttgtaccatcggattcattcacaattaaaaaacagccaccttttttgaggattcggtacacctctttaaaactttcaagaggtcctggccagaaatatacggtttcaaatgctgtagccaaatcaaaagtgtctgcactaaaaggaagattcaaaacatttgcatgagtaacctgcaatcttccgtttttaatcgcttgctgattgaactgttttgttttttggacagaaacctcagagtaatctaaagcatgcaccgttgcagccggaaatcgctttaataattctgctgcatttcgcccacctccacaccccagatctatgattttagatgggtgcaattttgtaatatgctccatcccccaatccgaaacagcagcgtggcctttattcatacttttcaccataagttcgcccagcaagccttctggttttcttgtgctattaaataatttttttacaattcccatttcccatttccaacccgttcttgatatatttatatctttttcctgtattcgattcctaaaataaacaacccagtgataaatatgattaaaaaacaaccgatgggaacagcaataccatgttcaagcatggtacaaatcaatctgcccggtggtgttatccaactcgttacgggatttaagatacaagccaccagcagaataacaatgccaatcgttccactcaaagttaaaaaaccgccaattagtgtttttttcatagcatctacctctttttatatccgaagatattaccggttagcattaactaactataaatataccacaacagtcagtaattatcaagtattttcttattcatcaaaatccgggtacagttccagctgggaaaactcggcgtcgctcatagcctggagcttcatcagggcgctgtccgtcagctcccgcagttccgtttcctccggcgaaagttcgccgcgcatctcggtcagagcctccatcagcccggtgcggctgccggtgttgtaaatgcacatcaggttcatttcctcaaaagtaaagtttcccatatcaaatctccctttccgcgctctttttgggcgctgcctttttgcgttccgtccggggctggcttttcagctgctccatgacggactttttcttgtcccgttcctctcgatgggcggcggcagccaaatccataagagaaataggctggccactgcgggcctgctgttccagctgcgccacggtccgctcttttgggccgttgttgatgatgccgtcaatcatgccgtagtcatcctccagcatcatttccgcatttttcagcggattgtccggcaggaatccgggaatctcggtgaaaccaacgctgtcgcagtaatgacaggataccttaccgtcctgcttgatggcaacgatgtcgctgacgctcatggacggactgtgaaaatccaccggtttttgcaggttgaactgctcatacagcgtttccagctgctccatggcgctgccggaaccgttcagcggggcggtgtagatcatgtcataattgtttcggtccacagccagattgtgcgattgcagccagtccagattcataaaccgcacattctgcggatcgtcccggctcacctgataaatggcaaagcagctgccctcatgggcaagaaatgcctgctctcgttccatctgccgttcctgtcgttccagcaccttttcatggaacgccggactttgctcccattcctcgtgttccacaccgaaaagcccgccatgctccatgatttcctcggtgtcaaacaccatgctctccgtgttatcttcatggagaagatagacggtcagaccggcagcgtccagttccagcgcccgttctctggtgacaggcagcatcccgtcatagagatagccgtattcctgcatatccgaaacagatacttcgctgtcgggcatggggtactcatccaaagactgctcctgagcatcgggcagctgggtggcggcagtttctgcggtctgctggctgacctgttcctgcatctgctgacaggctgcatcctgcaaggtctcaatcatagacagcggtgcatcctgaatcgacggattttccagttccagcccctcacaaatctgccggacagcggcggaacgggacagttccggttcatccagctggccgccgtccagttctttcatggtttccttgtcatagagggtatagtcccagccagtatcgcacggctgaatatgcagataggtggcatcgttcagaagaaacagggctttctgcggtatatccgcctgttccggctcctgtttggcggtcaggtcaatgccgcgctccttacagatttccttatagtggcgttcaatgtcgttaatcagctcacaggaagtcttgttgatggtctccagactggctcgcagctccttcagttccttgcccttggaccaggaagcgatgtaaccgaaactgttttccccggtctggatgccgaaatactggcagactgcataggaaatgctttctgcttcgacttcctctgtgcgacggtcttttttctgttcttgcaaaaactgcgagagggtaagcataccgccgttaaaattcagtccgttctcatctgtaaaatacagcctgccttcttctgaaaattctaacggagcagtcaaaataacagagccagcgtggttcaccaccactctttcctcaacacaaatcgggaaaccggggtcatcatccgaaccgcgcaggtcatagcaataaacgccttcgggcagatcatcatgggaaatacgcccattggaaaacagggcgggtttctcaaacaactccacctcctgatattgctggtcattgtcaatctgaatctttttctgattatggagcttgctgtgtgcgatttcatggacagcggcggaaacagtctgcacctcgctcatgccttcccggatggcgatgcgctggcgttcgggtgaaaaatagccgtccatgttgtccgccatcggctcaaactcgatgggaaccggggcagagcgccgcaccgcctccagaaacgcttcataatgcggcacagtccccgacaagctggatgccaactccggcagcggcttgccgtctgtctggctcacatcaaacaccttgaccgggcgaaacatggggatttcgatttcctttttctccatgaccgccttgccgtctgcatccagaatgggggcatgggtatccgggtcgcgcttcatttcctcgattttctttttgtagggcgtgggggcgatgatggtaatgccatgctcaccctttttcacatggcgctcaaactggtttttccacttgttgaacccggccaccaaagtggcgtccggcttctgcatatagatgagcatggtgttgtttaccgaatagcggtggaagcgggacataacggacagatagcgcatatacttttcactctcgaacagttccttgatgccctgctcgatgccatctgtgatttcccttagccgctctcggttggtggatttattctcagccatgattttcagtctcctttccaaatgtgtgatttctgctgtgtgttctgtaatccatgccttttgttcttcttcattttcgtaaagaaaaaggtccagcaggtactctacataggttttcttctggatcgcttccacaaagagggggtgtggttcttcctccggtgtgtgaggagaataggcattctcccattttttcagcagatagtagtaatcggacagtatgcgataacaccgctgccggtcctcccgaaactgctgcgtctcggttttctggcgaacatagttcctccggggaggggcctgactgtcataaataaggccaaaatcctgcgccagcttctcggcggcttccttgggggacaggttgtagagccgggaagccaggtcgatcacatcgccggtggctccgcaaccgaagcagtagaaatattccttgttcaacttcatgctgggatttttgtcatcgtgaaaggggcagcagaccatgccgccccttttgacctcaatcccatatcgttctgcggcctcccgaatggtgatagactgcttgaccgtttcaaaaagattgtccatatttactcactgtcagcttttctaacaggcggtctgtacccggcagccttggcccgttcactggcagccttgcggcgctcggcactgtatggctcccggacggacacacagcgtttggggaccgtaaaattgtgcttatcttttttacagacctgttccgggtgttttttggaaaggcgggtcagcttctccatcagtttccggtcatgggtataaacttcggcggtgtcctcggcctggttgtagaggaggatggtttcctgttcgtagagggaaagtttcatcgtttgccgcctttctgccggtcaaactccagcttgaaacccacatacttcccatcgtccaccagaaccaccgttgcgtcgtaggtcttgccggttttttccgaatacaagccgctcacatgagcgcgtccctctttgagcagcgctgtcacaatagccttggtaggctgattacgcttcatttcccaccacttgttgtttttccagatggcaaatttacaggattctgtctggcagaagaaccctttttgcagttccgccacatcaccgccgcagcgagggcatttgcccaccacttcgcggggcggcgtgaacaggtactcagtccccttgatgacctgataggttcctaccaactcccggagcatggcgcagatcccgcccatgaagtcctccggggacagctcgccgcgctcgatctcgcttaaacggtgttcccattcagcggtcagcaggggcgattgcagctgttccggcagaacggtaatcagggacaccgcatctttggatggcatgagctgcacagctttcttactcttttttcgctccaaaaagccggtggacaccagcttttccaggataccggcgcgggtggccggggtccccagacccttgcgctcggcatcgtccggcatttcctttgatccggcagtttccatcgcggaaagcagcgtatcttcggtgaagtgtttgggcgggctggttttgccctccttaacggcagagctggaaaggggcagcgtctgaccctcggacagttctggcagacggcctccgtccggcagggccttgtcctcggtttccttgtccggctccgcatttttcagcccagcgcggtaggcagcgtccagcgcccgccagccggggcgcttcaccgttttgcccttggtggtaaactccgcaccggcacactccacggtgacagcagtttctgagtaagtatgcggttccgccaccgcgcacagcaggcgcaaagctacaagttccaaaatcatccgttcacccaccggcaggccggacaggtctgcgccatgaagattgcgggtaggaatcaccgcatggtggtcggtcactttcttatcgttgatgaccagagcctcatcgcaggaaatggcgatccctttgcgaaacggcatggcgttggcaaccagattgaccagcaccggcaatccctccgccatatccgaagtcagatagcggctatccgtgcggggataggtgcagagcttcttttcatacagattttgcagataatcaagcgtttgctgggccgtatatcccaacaatcggttggcgtcccgttggagggtagtcaagtcatagagggcgggcggcttctcggttttgtccttgcgctccacctttttcactgtcacatccgcaccctgacaggcagttttcagctgctcggcggcagccttatccgccatgcgttccccggaaacggaaaactcaggtagctccaggactatcgtgtaaaacggaaccggcttgaaggtgtcgatctcggcttcccgttggacgatgagggccagcgtcggggacatgacgcgcccaatattcaaagtgcggtggtacagcacggaaaacagtcttgtggcgttgatacccaccagccaatccgccttggcgcggcagagggccgcctgatgcagaccgtcatagtccgcaccggggcgcagatttgcaaagccctcccttatggcggagtcctccatcgaagaaatccacaggcgtttcatgggcttttggcagcctgccagctcatagacgctgcggaaaatcagttcgccctcgcgtccggcatcacaggcatttaccacctcggtcacatccggggcgttcatcagctttttgagaacatcaaactgtttctttttatctttgtccaccaccatctgccaatgttccggcagaatcggcaggtcatcatatcgccacttggcgtacttggggtcatagctgtctgcatccgcaagaccggccagatgtcccacgcaccagctgacacgccagccgttgccctccagatagccgtctttgcggacagtcgcgccgatcacggcagccaaactctgggcaaccgacggcttttcagcgattaccagtttacatcccatcatcttcatcctcccattcttcccgcacagatgtgtgcagttttttctcaatgctgttttcctcatccagcagcaggtcatagccgaaccggtagtcatagcggtacagtttccccagcagatcgttgataaggatacggcaggccagaatgacacgggttttgtccacctgcatcaaccggtagcgttgataattgctgtaatattcctcatggcggcaggtacggcggacggtttcctcaaacaaaatatccaccgggtcctggcagccgtcctctttttcacattccatacagttcagaagttccatcaccataggaaagctccgttcatccattggggcttcttctgccagaaaacctaccagtgcagacaaaagcaggcgggcggctgtctgttcccggtctgtcaaaaccgccattgtctgtgcggcattcggcaggagcctttcttccacaaaatccgccgcgtctcctgaataaagctgacggatggaatctatggacaggggaaccgctgcggcatccagggagaaatcaaaaggttcctcccgtctgggctttttccgaaatttgctccacacagttgagagaatgtcgcggccaaaatacgcggcgatcaccagcaggtcaaaaaccgcaagcagcttgataaatgtaatcagaatactcattttttccgtttcctttctttgagccagcgttccatctcacggtggcaaatgcccacgcagggacttccataattcccgcagccataacaggggtggctttggggcaaagagggaggacgggaagtttccttcccgccctccggcctgcgtgtcatcattcgttcatagggactgtctgtgaaacgagtcatttcacgctgtcctcgtcatcttcttctgcgctgcccccgtcagcgtccggctcgcccgattcctcgtcctccaattcgatttcttcctcatccggcagttcctcgccgtcctcatagtcataatcgtctggattgctgctgtttttgtggttggccttacccttaatgaatttgaaataggtaaaggcagcgccgcccatcacagccagcaccagcagcaggacaaccgggtttagtcctgcggattcttttttctcaggctccgcaggttccgcaggcgtttccggctccgcttccttgccggtacaaccggtcatgtccgtactgcacacctcgcatttggtgttgaccgcaccggcttcgcatttttctgtgcagttgcagacaacgggtggtttctcggcggactgcccatcctccatcagcgccatcaggtcagcttcatccacctgatttaagaaatggacggcggtttccttgtcctcgttggcccggtcaatgaggatgtaaaagtagttgcccgccttggtggtgacggtaatcagctgcttgttgccgccgaaatcatctaccagcgccgcgttgccctccggggtcagggcaggactgtcctcggttttttccaccaccacattttcatcgttggtggcatcctctgccgggggctgctccgttccctgggcaaaggcggtcacggaaaggcccatcatcagcaccagggcggcgcagagggccgaaaaggtcttgaaaattctcttattcttcatgggcggtgtcctcctgttcgttgtagtcggcggaggcagcggccatgccggggaccgtaccgccggagagcatagcgttcagctgctccggggtcagccgcagggcgcgcaccatctggacgatctccagattttccgcttcggttttctgcgcttccagcgttttcagcttttcctgatactctgcgattttctcacgggttttcgtaatttcccggtcaatgcgttcaattttcgtagccataatcaatcactcctatcaaaagatttgtcaccagttcatcaggccgtagcccttgatgcactcatagttcacatcgtagcttctgattttgcaggcatcgccgctgtttccctctacggtataaacgcggctgccgtctgtgccgatgacgatgcccacatggtcggcgctgccgtccaggtcccaatcgaagaagatggcatcgccgggggcgaggttgtcatagccccgcgcgccccattgcccatgtgactggaaccagggtacaccctgggattgacagcccgcaaagcgcggttcagacagccccatctggccgtagcaccaggacacgaagcaggcgcaccattccacgcgggaattgaatccgtaccagctccagtagggctgaccgcccacatttcctacctgacgtttggccagttccaccagctccgggttgccggggcgtgtgccgtttacaaactccacaccctccaaactctcggaatcactggtattcgtggaaccgccgccgaagatcagcggcttgttgcccagtgtctgccggtacacctgatacatctctagctgttccggggtcagcagctccgaagccacagaggatataggcttgctggtgagcttcacattgaggatgtagtagttgtagggaacctcaacggtatagctgttgccctcgctgtccgttcgggtttccgtccggtagcgcacctcgacttcctcggtgagcgtaagctgatactgtgcatcaaacacacgctccagctccgcctgtgcgctctggcgagtatagccctgcaacacagcagacagataagccgccaactcatgggggtcatgcccgatcatatccaggtcataacggtattcgtcatatcccggatggctgatctcaatgttgtcgatctcagcttgcagcgccgcttccttggcggcgtaatcggcctccaccgccaccagctccaggtcatccgacggataggtagagccggaaatggcagaaccaatgctctgcgccatcatggagcaggaggacatggtgttgagcagcaggcagatgagcagaaaaatcgcgcccacaagcaaaaagccttttttgtggcgcataacaaatgctccggcctgctgtgccttttccttgaccgtcttggcggccttgccggtcttttttgcggtgttggcggtgtttccggcagcttgaccggcgcgcttggcggcggcgtattcctttttgatggcctgcttctgctgccagcgtgaaaacggattactggtaagctggggattttcccgcagggacttttgatacagggcgtttacattggccttttccagcttttgttccgcctgtgccgccttgcggtatggcttcagcttgtggctgcggtagccttcccggaccagccgcgcaccggtttcaacagcttcctcggacttgtgggcgctctccacgcccacattgtcctgttccgtttcacggatttccttgtggagtttccccagcgccgcatctcccggagcatcccggaccgcatgggacagcttggagggcggctttttcttgtcctccagcaccagtttggtagtcactttgccggtccccaggtccaccgctttttgccgcacctgctttttcgggattttcgcctgcgccttgtctgctttgacggcggcccggtctactttacggatgggcttctccagcgccgggtcagcccgttcctcgtctgtaaagcgcaggcgcggttccttacgcataccagccacccgccatcaggtcatccagcagcacacaggtttccgcatataccggaatctgaatggtttctgccggaaagaccgttgtggacaggaaaagcgccatcagggttcctcttgccatgtcccgatcctgaatcgggctgcccataaacagcttgggaacatccggtatgccctctgtccagatatggtgaatccgggtaaatccggcatagcccttgggcgtgagattttttgctgtcttttcctgctcatagcagtaatggacggcggcgcgaagcagttccaccatctgctcacatccgctgacagcggccagaagcagacctgcgcctttttcaatttctttctttgtcatgctgttcatcctccttttttaagtccaacggcttggtggtcatgatacggtacagttccgtattcttggggaagtggtccacaaaaggcaggatggtggagccgtagaacaaaagtccctcgccctcgccggagtgggtcacataggatagctggtgcggggaaatgcccagctgtttggcaagaatctgccggtctccgcccgcctggttgagcatatacacgaagtcggagttttcaaagatgttctcaacctcgcggctgctcaaaaggtctttgacattctgtgtgataccagtcgggatgccgccccacttgcggaaccgcttccagatttccactgtataggcggcggtctgttcctctttcagcagcaggtgcatctcgtcgatgtagtaacgggtggacttgtgggcggcgcggttgatggtgacgcggttccacacctgatcctgcaccaccagcatcccgattttcttcagctgcttgcccagttccttaatgtcatagcagacaatacggttgttgatgtccacattggttcggtggttgaacacattgagggagccggtcacatagatttccagcgctgtggcgatgtactgtgcctctttttcctcctgcgcccgcaagagattatacaaatcctccagaatgggcatattctccgggcgcggatcgttgagatagtcctgatagaccagccgcacacagcggtcgatgatggttttctgcaccggctgcaagccctccttgccgcccacgatcagctcgcacaggctgagaatgaagtcggatttgagggacagcgggctttcatcatccgaatagtccaggttcaggtccatggggttgatgtagttggtggaagtgggcgaaattttgataacctgcccatgcagacgctccaccagcggggcatattccgcttccggatccaggatttccacctcgtcggaagtcagcaggaagcagttggcgatctcgcgcttggcgctgaaggacttgccggaacccggcgtaccgagaatcaggccgttggggtttttcagcagcttgcggtccaccatgataaggttgttggacagggcgttgatgccgtagtacagcgcctctttaccgttctggaataattcctgtgtggtgaacggcacaaagatagccgtggaactggtggtcagcccccgctgaatttcgatctgattgagacccaaaggcaggcagctcatcagcccttcttcctgctggaagtccagccttgtcagccggcagttgtatttctgcgcgatggagcttgcctggaacacattgttgtccagctggcgggggttatccgccgtgttcagcaccaggaaggtaacaaggaacattcgctcgttgcggctctgcaaatcctgcaagagctttttggcctcaacaccataagtggcaaggtcggagggaatgatgtctatgtcgtacccggcacggacagcctttttctgttcctcgattttggatttatccagatcggtgatttttcgtttgaccgtcttgatggccttgatctgatccactgactggatgtgcaggctgacaatcaggttggattccatatccagaaaatcggccagcatccggtcattcagctctggggccaaaatttgtacgaagctgacggctccgtacttcttgcccatgcggaactgcttgccggtgcggaactcaaaggagctgggggcgataaagtccttggtggacaggccgctggaggggagccagtcccactcaaaccggaacggcagctgctcgtccatgtggaagataccatgcagttgggcaagccgcgcctttccgtccagcgtttccgccgccacgcccagccgcttgaagttattgagaatgtcggtctcaatgcgctccagacggggcttggccgccttgatgctgtccgcgtcaatgccaaaggtgagatacttggttttgatcaggccgttatttccctttgccagctggttttgcagcatggtcatgtattcgatgcggatgctgtcaaaatcgtccccctggagagggatgttgatggcgcgggcaaaggtttcctccgatgctgcaaggttcaaaaaagacagctcaaactgaatcgagctgtcgaagtagttgaggaaatcgcaccagccctcgaaaatcgcggttttatcctcgttctgtgagagctgatagttgatgtcctgaaattgaatggtttttgtgtagtgaccgtctgatacccggcagataccgtccggccacattcgttcataagggatactgtcctgtgccgatttttcctttttgtccgtgcggtttgcgcgggcaatcgcagcttcaatctgctttctgtcggcgcgggacagctttttctttgttttgaccggctgcacagctttttcctcgttttttccgaacagccggtgcagccagcgtttgattgccgtaaacaatgtgtgacacctcctcgtcgagatttgcctgccgctgcagcacggcatagaagttattggtgcggtaggggcgctgcctggggcggatcaccgtgacgcggatgatattgcccacgatcttttccaacggctgaccatgcttttcgtacatcgccagcaggaagaaaggcagcatcacgaacatcatgcacagggctgccgtactgttcccggcagagccacggagcagaaagaacagcggtacgcccaaaagcgcccctccgccgaagcagactaactgccgcttggttaagttgaaagcaaccttggttttgactttcgtcaggtctttgggtacaggtacataggccatagaaactccctcctccttaatgagcctggaatacagcttttgcaaggcttccggtcttaaagagggtaaagcacagtaaaaccgtatagcccacacagctccaaatcgccataatcacatcttcctcggtagcgatgccctgcaccagtacagcataaatcgccacacagacaatgataagaaatgcctggaatcccagcgccagcagggagcgcagatagttctggcccatgccgccccattccttgcccatcatggcagccatggggatgggcgcaacggatgtcacaaggtaaatttctatcatacggccataaatcacgatgaaaatgcagatatacagcgcccacatggtaacgccgataaacatactctggaaccaaagcccgaacagcggacccaaatccatttccatcagccggggttccatgtccgtaaggacagaggaaatatcaatggcggcatccgaagaaatgatcccggatgcctgtgccaccacgctctgcgccatatcgaacacgcccatgacgatattccatgtattcgtgacaaggagtatggctgcggctgacttgaacacccacttgaaaatcatccaggtatccacatcatgcaggttgtttttatcggtaatcatctggattagttccagcgtcattacaatcgccagaatcacaccggcgatgggaaccataatggagttggagaggttctggatcatgttgaaaataccgccgttccagccctgcggtgtttgcccaacctgcacggatatatctccgacctgctggtttacagaatcgaacatcccggacaggtttcccataatgccgcctaccagcatttccttgagccactcagtaagcgcgtccagcagaaaatccatacagtgcgacctcctttcagcccctcccgattattacgggaggggcaaggattttccagggacagtttagacggtaaacagaccggagagcaggggtacgaggaccatgccgaccacggcgacgccagcgccagccatgagctgcttcatgccttggcttttttcttatgtgtgataaagaagtaatagaagtgtaaaaaattttgccgttcctatccggcacttagctcttgtgtcggataggtcgggcggttattcgggcaagtccaccttgccaacaaaagaataataaatctcaatgtcctgtctgcgggtcttgttctcgtcatagctgcactcatgtacaacgattttctctacaaactcccgaaacaaagtaggggtaagttcttcaaagctggtatgccgccggacaacattcataaacttttctgcgttcacagtggcttcctgtgctttggaaagctccgcttggatagcggcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcctttttcttggcggcgttcctgcgtttgcccccgtcctcgttctgctcaattaagagcttcataaaccgggcttcatgctttgccgcatagcttgtcactttccgcagattggagagtacaccagcggtcaagaggtcggtgcggataaagtgtgccgtacagtcatgggtgcgtttcttgtagttgccgcagatataacagtcctgcttgcgcttgtccgtctggtatcgctgctggtacatgacgctgccgcagtccgcacagaacagtatgccggagaacaagcccacttcatcatagcggttggggcgtttgcgctgcttgcgaagttcctgcacccgttcccatgtctgggtgtctatgataggctcgtggtggttctcgaaaatcacttgcttctccgggggattttctacgctgtgcttgactttgtaagagagcttttctgtcttgaaatttaccagacagcctgtgtattcccggttttcaaggatatgcacaacggtattggtcgcccacttgcactcatagccggggtggtagcggcgggtgctgcccgtcctgcggtattccagcgtccccggcgtggggatctgctgctctgtgagcatacgggctatcttggtcggaccattcccggcaaggcagaggttgtatatctgcttgactacgggtgcagcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaaatcattgtcgccctgtgcgctgtccactccgtcattgatagcgatgaagcggacacctttctgtgggaaaatcatttccgtatacattcccacttgcaggtagtttcgccctaacctcgacatatcctttacgataactgtcccgacttttccggcttcaatgtccgcaagcatggcttggaaaccgggtctttgaaagttcgcaccagaataaccgtcgtccgtgtaccagcgcagattggaaaagccgttctgctttgcataggtttcaagaatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggtggctgtctgtatagcggcaaaagcgtcaaatctgcttctttatggtcggtcaaatcgccgttttttgtgtagcagatgattgggattgcatagtagaaaaactcttgttcttatggtaaaatggagctaatcaatacaagggggtgtgacaatgaaagggtttgtccgtaacaatcagtacctttctctttgtggtctaaattgtaaattatgtcctatgaatttggcagggcattgttccggttgtggcgttgataatcaaagttgtaaaatcgcaaagtgcagtattgaacatgggaaaatcgaatattgctttcagtgtaccagcttcccttgtgacaaatacgctcatatagatgattttgattcttttataactcatcataatcaaatgaatgacatggaaaaagccagccagatagggattcccgcctataatgctgaacaggaagaaaagcgcaaattattggatttcctcttgtcacactataatgacgggcgcagaaaaaatctattctgtgttgcagtcaatctcttaacgattaaagaaattgaaaatatcttgcaaacagttaaatccgataaggattttcaaagtatggggaagaaagaacaggcttctgttatcgcaaaactgttgcaggatatagctgttccaaaaggcattgagttgaaacttcggaaaaaataaagttgttactgatattccagcggtcatgctccccggcgtgaccgcttttccatgtcatcacttatgcgctgaacggtggcgtatgtccggcagcagtttccgcttccagcactttcatcatcttgtcggctgcggtgtcggttgcgccctgcttgaagaagccggaaacggtaaggacggagttgcccatgcggatttccgtcacacagtccgggcggcggtctgttttggtggtgcttgtctgtttcgtttctgtcataggctctccttgcgctgcttcatcagttgctttaagcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctgtaaacctgttccagcccgtattctgtccctcgctccataccgaaatcatcaagtatcagcagggggtagctgcaaatgcgggaaatatattcgttcctgctctcaaagctggcggcaaggtcattgagtatcgttgcaaagtttgtcatgcgaacggcaacctctttttccataagggcgttggcgatacaggcggcaaggtagctttttcctgtccccacgccaccccaaaacaggtagccgatattttcagcctgcatggtttcccagctctccacataaaagcgggcggtttcggtctgcgggtttctgccgttgtcatgctcaaatgtccagttccgcatagcagggtcggtaaagccccggcgtttcaagtcctccactttttcaaggtgcttctgtctgctttcagcggcttcccgtttttcacgggctgcccgctggcagtcgcactctgccgggtgtcggtcatgccctaaccattgggcggtttcttttgaaaagtaggcttcttttggcgtatggcacttgccgcagtataaaagcccgtcctcgcctgtgtagtcctccgcttcggcggtagtggttgtaatgtccgtaatcatagcttcaatctcgtttttcataagctctcgccctccttgcatgaataatcgggtatgccctgtttcggggcagccttgcctttggcagcgtcctcctgcgcccacttgtaaatggtggctgcatggctatggtactgctttccggtggaagcgatatggcaggaaagccggtcaatataatactcccacttgtcgggcagctctgttttcagcccggaaagctccgtatcggtcagtatcacattgttgtatctgccataagcggcgggggcggggtgtcccgtttctccctctctctctttttctatctctttctctaactctatctctatctctggtggacgaatgtcggacaaatgtccgccttttgtccggggcggtaaaagtgccttgttttccagccttgcagcccgttttctctcggcttcggtagaggattgtcctatcatcagctcaatgtcggtcatatagaaagccccgctgtcaagctgctccacaagccccaactgccggaaaatctctaaagccctctcaaccgtccctatctggtggcgggtcagtgtcgctatcatctgcgctgtgtaggggatatgctcgtcaagctgcaatttcccgccgtttttcagcgattttaagtacagcttcaagaggatattggaatataaaatcccgtctttcatatcttccagcagcacaatggagtcgctgtcaaaaaagttctctttcaacttgaggtagtaatacttgcggttatctgccattgtccccgtcctcctttttccggcgtttggagtagtagcgggggcagagtatgacaaccgcccggaagctctgcttacagctatgggtacagccccggcagaggtcgttgtatgtgatacggtcgcaggtggtattcccgactttcacttgccgcaggaaaaaagaccattccagccgccgtttcttgctcattcttggcatgggtgcgctcctttctgccgtttccgctggtgtggcggtatcggcggtaattctgtatcatctcggtatcattttcggggtttttctgccctgtaagcccgtcaaaaaatcctttggtattggggatagggtacggggcagcccccttgttctgtatgggttcgggtacattttggggtggtttttatcgctcctgttcctgccttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcagggatttatagctcggcagcttggaaatgccgttctctctgaaataacgggcggctgcgtctgctatgataaagtcgctttcgtgcttctgacggtaggctgcttttgctttggcgtttttctgctgtttcagcccgtcccggacagggcgggtcttggaataggcaagcacctgccgttgcagctcctttttcccgtttagcgtcttttccacctgctttagctctgcaaggctttcctgcatggcggtataagcggcagaacaggcttcgtccagttcctccggggaagaaaatccatactgctgataggcggtaacggtagctgccatttgctttaggttgtgctttgccgcccagcggtcatagcccacgccttttccctcggctcgctttgttgcccggtcaaccatgcgctgaataccgtcctttttcggggtggtttgaacagcttttttgccctgcaaacgctcccttatgctgcgagggtattcgggtacggctgcggtctgcttggcggctctgtgggcgttctgttccaaaagggcaagaacggcagtgcggtcaaaatcatcgccaagcttgcgggcggtaatgggctttgtcctgtccggcgtgaggtaggatagccgccctcggctctccttgacagttacgccctgttgcaagagaacggcggcgaactcgtcatagctggcggcagaggacagcgcggcgcgtatggtctgccgcaatttttccttgtctgtttcaaacttcgtgggcttggctggctgttctccggctggcaaggcggcagcttccttgtccagctttgcctgtcctttccgctgcgcccaatactcacgctcggtaatgcggttcttgctgccatgcaaaaggtcgatttgatagagattttcccggtggcacagttccatgacttcggctttgaagtattccatcgctgcgtctgtgcagcggtgtttgcacccggcgcgggtgtctgccggtctgtccatgtagggcaggaacggaacttccgctatccgcagagaattgataacaatatgcacatggatattgccgctgtgattgtgtccgtccgggtgggtgcagacaatggcttggtgtccgggaaactgtttccggcaaaattcctcgcccagcgcctgcgcccggtctacggtcaagccgttgtctactgcgtcccgtgggtcaaagctgataatgtagtggtggcttttcacatcttcccgcttctggtttttcccatagcggagattggagcgcatacaggcaacggcaaaatcctcgccgccgcagttcagcgttgctattcggtagtcctcccggagcatgagccgcccgctttcatcaagggtgggcttcatggtaaactcatcatgttcaaaggtgaggtactgctcggctgcgccataatccgcatttttagagctgatatgtttgaatgttgccaacagcgtcacctacctttcgcaagacttcaaacttcaaggcggcaaggtcagaaatggcggcgcggacttcaacggacagggcgttgtatggtgtgccgtactcattgagggcgcgggcaatctgattgaggttgccgccgatttttccgtattcagcggtcagcctgccaacggcggacagcagttcatcattgaccggggaaacggtaacgatggggcgaatggtcgcccgtgtaatggcttgccggataaactcggcttggctcatgtcatagtgtttcagccgctcggtgaagtcggcatattcttcctcggtcatgcgggttttgaccacatggctgcggtggggcgtgttgtattttttcttcaagcgttgacctcctttctcgcccgacagggcgcatgagcagggtttggggaaggcactccccaacaagatttaccaaaggggaaaaaccgcagatatgcggattttggcaccgtggtagaatcttgctctaagaaactgccagactgccgttcacttcctactgccactttttcagaaaatcgcaaccaacttttttataaaaggctaccggattgccctcacttgctactgccactttttcgggaaatctataaccagcttttttataaaaggctgcaggctggcattctcccccttactccctacaaaccacaaaagagcagaatggacgaactttccggcaagaacttttccggcggctcggtctttcccgacaataaggcgtttcggaagctgcatttggcccgctgtctgaaaaaaacggcagccttttttgacttcactatctaatacggaacttttggaaatttgccaaaaatgggcgcaaaaaaagcagcaaatctttttcggatttactgctttgtgtgccgctgcggggcggcgggatattcagtttttatgttatcggtcaagccggaacttgaacaggctttcaatcagctttgttctgatgtaatcctccatatcagaattataatagccgttcattttggagaaatagcggatatatccggcatagcggtcaaggacagcctgtatcgctatggggtcgtcctcatgtgcctttattatcgtgtcataggggagaagtcggttactcatgggacaacacctccatttcctttttcagccgcttcaaggcaagctgaatatgccgcccgattgtgctgcgtgtccagccgctttgttctccgatttctttctgcgtcaagtgctggaagtaatacaaaaagatttcttcctgcgtctgttccggcaatcgggcaagagcagccacaagggagcagctatctaaaaatatcgtctgcccccggacagagaacggataagtttcgccatagtccggcacttgaaaatactcgtctgtggtgcttagtgggacaaacttttcttcggtcaaatattcaagggagatttcccgtttccacctcgccgccagcatacgggcagcgtcaaaggacgcatgacgaataacaatccggcaataggtatcatgggtatagcggatatgttcttgataggcttcgtattcagtcatggaaaatccccctttcttcgattatgggaaagggcggcagcacttttttgctgtcgccccttgattacccaccagcaaggacaggcggggctgtcaacggtgggcgcagcccattcacttgccgttgaccggctcggctggatttgctatctttactcgctaagtatcgttgacggcgtaacagactgaaaaacaatcatactgtcaaagatgtcttgcggagtaatcgttactgtatatgctgactttaacattttctgcataccggacaaactaacattaagtgtggtaattgactgtttgctgctcaaaatctgctcccacacttcatcagaagttgcacttgcaaaatcaataaaatactgaccattatctgcattggagaactgattattcaaatcatttgagttactaacttccaaaacctcaaactctccattgcccttttgagagttaaactgcgtttcctgtgcgtctgttcctatcgaatagtatccgttaccaagattgtctgaaagtaattctcccaaacaggtatatcctgcaacagagcttttaccgatgtgaccattatgaccattgataaatagaacggtattatcgccatgctgtaaaaaccactctaccttttcatacatatactggtcacgggtagcgttgtagttatcacttagctgtacctcacaacaggcataaatagtttttgcacattcttttgcaaaatcaaaagccggctgacctaaactgtctacaatatcggtttcaacagtgtccagtttttcaataaattctgaaacgctctcctttgcgctattcaacgccgcttcatctaaggaatttctgttctcgtctgtaagttgtgcaaacacttctgaatattctgcgcttaattccggatgagtttggtcgataacagaaaacagatattccttgttattatcaaaccgctgtacatccataccataaaaatgcaatgcttctttttccgaaacagtttcattgtaggaacgcatccagtctaccaaatcagccatttcctgtgtacgataaatggcaaatcctatttctgcaacgacttcttcagcagttccattaccgccattgatatactggtctactttgagcgctccgccaaaatctccctctatgatgaaagtgtggcaaccattattctctaccagagctttgaatacatctaatttcatttgatgatactgcgccacaccatgacttgcttctcccagccctacaatctgcacatcagaagatacagaaattgtccctatgtcagattgtgtataagatagatctgctgatatagatgattttgtattcccacacccagtaaaaaggataaaacaaattgctgtcgaaagacacaaattaaatattcttttcagcttcataatagatacctcatttttcttcatcaacaaatttaaacaagtcctcaacagtcacatggaatacttttgcaatatccatagctaatttaagggacggattatatctgccattttcaaggtgaacgattgtttctcgtctcgcaccaacaagctctgcaagttcgctttgtttatatcctgcctgctcacgatattctttaatttttgtaacaagagccatatcatacccccttgctgtctataatcacaaacatcaatgtccgaatgatagataaaatcaaaatagacaaaacaataatccacccaatcattcccatattgatagcattaacatgaccaagaatagcacagccccaagcaactacaaccataacagcaacaaaaatcttcaaacaaaatgagtcacaccgtttcaagtttcgctctgccatttcatcaacaccttcctttttgtatttcttaattctcatttgctgaaatgcaaaaaaggcagcaaggaaacagccaagtacaagctgtaaagttggataccagtctttccaatctgttcttgcccacatccagtagtaagatacaagaatgattgcgtagattatttttgttccaacaatttctcttaaagatacttttttattcatatttctttcctctgtgttatatatttcgcactttcgatgttataaatatatcactcctatttgcgtatgtcaatagtgaaagtgaaatatttttaactttcatttttcggaataggggctgccgtcaatcaaattcttgtgtgttactttaccgcacatgaacattagcgccgggattgtcatttccgtaaccttccagcaggttgatgacaccccagatgccgagaccagcgcccagagcgataacgagagtctgcaaaacggtgattgcctgattaaaaaatgccataaattatagttagccggaatcgttttgataaagtttcagtcattcataggcatacaaaagccggacaatccgccgcccggtttccgggggctgattccggctgtcctccttttttcattattttttggtgactgtccgccttgtacgccaatggtcccaaaagggcagttgcggcgaatagataagaccactcctttcacagcggaacagatttaagcaccctctgtatctacttcgtacacgtcgcagacctcattgggcttgagcttcagccgggtggacagaaatgcttcaatgtcaaaagcgttcttgtcgcttgcatcggctgtgtatttgaaattggggtgtttggtgatgtcgtacttatccgaaaggaaagggcgcacaccgcgcagctgaaggatgcacttgccgccgtccatgacggccagctcgtcctggctcatcagctctttccctaatttttgataattgagcgagtgggaagtttcccgcccacggctctctccggtgttgtaggtgtcgatggtttccttgcccagcacggcagccagttccttgagggtagtcggctccttgccgcccaggaaaatggaggtatccatattgccgatgatggtatcggcgttgtccttgtaaatggctttgagctggctttgcgcctgcaacaccagacaagcggagatctcacggcttcggatggtggccaccagcttttccagtttgggaatctggccgatgttggcgcactcgtcgataagacagcgcacatggaccggaagtctgccgccgtaaacatcatccgctttttcacacagcaggttgaacagctgggtgtagcacatggagatcaaaaagttaaagctatcgtccgtgtcgctcataatgaggaacagggcggttttcctgtctcccagggtgtccagctccagctcgtcgtaggaagtgacctcccgcagctccgcaatgtcgaacacagcaaggcgcgcaccgcaggaaatcaggatggattttgcggttttgccagctgccagcttgtactttttgtactggcggacagcgaaatggttgggcttctctgcctccagcgcgtcaaacatcaggtcaacggataccgataggtaaggctctgactttcgtctcggccttttcccccggcccacaccggacgggcacctttcagcgcatccggcgtaccctcttactttgtgaagattcccccattccaaaggggtctcttgctcaacaagcaaacgacatattcacaatcaatctctttgcaaggaatcaataagtgcttttattctccgtatctttctgggaaaaatggaataaagccgctccggggtactgctgtgcagtatcgtatgttccatttctgaaagcacacagaggttttcaaaatcatttgttccgcctttgctaagtggtttgatatggtggcagtggtattcgtctacggggacaaaatttcccgacagatagctgacacctttcatggaactgtatttactgattctgaacatggctaaccggctgtttttgatgtattttgaagtgttgactaagtagctgatatccttcattgatacaccgggattgtgcttcttttcgccgtaggcataaggatttttacggattaccttgcccttttctgcagctatcagtttattgtcccaactggcccattgaatctcaatgaccgggaactgatggaagcagtaatagccacgctttccccatgagcggtattctccgccctgaaagttatccttgtaagcttggtcttttatgaatttaacatctctgctcattgtgtgataaaacaattctttgattcgccaacctatttttctaaagctcaaacaaaacagagacatgcctttatagtagttgtggactcccaccacataggcattccatgcgtgtattgtttcaaatgacggattgcgcctgatgtcatgtagcagttccctgcatttcttaacaatcacgtcctctttgctttttggaagctcatttgtcaccatcagcttccccttttgctgtgggttcttcgtctgctttttataggcatagaagtcatatcccagatacttcatcttttcccgggtaaggtcatatatttttgtcttatcctcgttgatttccagcttcatgttccgtgtcaggtaattcgtaacactgtatttgaatttcacagcgtcctcataatccttgcacaataccagaatgtcatcagcatacctcacatgaatcccaacttttagatttgtgagtgcgaggttgcgtcgcttgttcgcatagttgtgaaactttgcaacgcttctgtcatgccagcaatcaccctggtcacggagccatacatcaaatcgatgtagatatacattactgattaacggccccaaaatcgaaccttgtggagagcctttcggattctccactttacaggaatcctcatagtatccctttttaatgaaacggtagatatagttgaggattatctggtcttttatcccgatatgccacagttcccggtatgctatatccgggtctatggttccgaagaaatctttcatatccacggacaggacatagggcattgtctgacattggcttttcacctttgccagcgcattgtgagtgctgacctgtttccggaatccgaatgaactctctacaaattttgtttcacaatagggttccaccaccagttgaatacatttttcaaccagcttatcccaaatggagcaaatcccaagaggccgcttcttcccattgcttttcggtatgtacgttctccgtacataatccattcttttgtttgtcagacggtctttcacaatctccgcaagttcctgaatagagtagggttccagagttttgatgtttgttttatccggccccagtgccattcttcccggacttttgcttaattgacgcagtgcaagggctacgttatcagtgtcataaaccatgacgtggagtgcccgtaggtcaattctgttattctggaaatcttcaaaccgcttttccatgtccacaaaatagatgttattggtactcaattacttttctttggttcttcataggttgtcgcctcatttccgtaacgaatagtctcttgcgtctaatcaggcgaatcggaaatattgttttattattcaaagcaagactaaggcccttcgctaccccctgtttcttgacagggtatctacgctactatggccccgctgactacccgttcataacctttctggccttaccctttcagtgcgggccgtccccggctattcctaaacgtcgggcagttcgcccttatcaatatgactgccttaatactgcacttaggacttcctctgctccgtaaacctgggtctccccgatacgttttacacgtattctatggcggccataacgccatcccccatagtgacaaaacgaaatcacgtgaggtagatttattattccgtcctctctgcacagcagagcaggatagggttcataacgaagctttagcaaatgcggaatgttgaatccatatgcagtggaacccggggtgtgctgtcaccagcagtgtccccgccttcacctatgcttcgcgactgcctgttaccagacagccggcaggagtattagtcgaggtcggatacatggaatatttggcttccatgccgcctccagtcatatcaattacctacaagagtgtgccgcttttcacctccttagcacctcttatcaggtttgcagtggtgtcaccctactacgggagttttacactgcaattagggtcgcacgatttttgaactcctcgtcatcctcccggacttccatagcgttgatgaactcaataagggtggagaaattctgttcctccaccggagcctcatagtggatatagccaatgagcgcacaatagagaagcgtttctgccttgacccagaaatcgtctccggccttgccttcgcctttggtattggcgatcagcgtcgtgaccagcttcaagatgtccttttcgctatggatataggcgaaagggttatagtgcatggacttcttgaagttgatggtattgaggaccttgatgcggtaaggctcataaatgaccttgccgtgtttatccttcattggctttccgtccttccccagcttgggtgcgcccctttggagcatttttccgcactccaccaaaatggttcccttcgggtctgtgaccacataagaactgtgcatctgcatcagatatgaggtaggcaccctgcgccttgctgactttcatcagtaggtttcagggagccgcctcccaaaccggacgtacacctctcagcgtatccggctttccatgaatcaccttgattctttggtttcgtgtaagagttcaaagcagtcagggcagagagccagagattttcttctcattttcagcattttctgctcaaatatatccctgcctttcagcgatttcagcgttcttacgtggtgcatacataaatagtctgcatgttccccgcaaatctcgcatactccggcttttatgcggtttactatcgtgtgcctgctgtcatatttcctataactcggcataacgtctgccacattgtcatagccgtcgctgtgctttctgaatccatcatggtaaaattcgcagtatttacgtcccttagttgtatcgtatgggattctcagtactccgtttaccatgtgccacttcttaataacactgacattcgttctgtgctttcctgccagagtttttaacatgctgtaccgcaccatgtagtaatacttgtgcaatgcgcctacgttttctgctatccgatagaagttatataaccctcgaatttcggaattgaaagtagacacaatctctgcatcgctgcggttcatcaggtctttccttggcataggacgccacatttctttgcctgtgtcattgttgcgtttcacctgtatcgctccccgttccatcgcttttttaatccatttttctttcggcatatacaggaatacttttccataccacacccgtttcatgtcgccgtttttacaacgcttcatgttcttggaatggattactttgaaatcgtaccccagatagcgtaccggcttactggaatgggtgactttcgtcttttcctcggacatttccaaatgcagtttttcttggagaaagatttttacatcttccttgattttttctgcgtcctttttggagccgataacgccaattacaaaatcatcggcgtaacggttgtactggattttcttgaagccttcctcaaacggattgtaatagtgctgattcatcttcttccttctggaatccttaaattcttttaccagttcaggagttgatttttctgcgcccattaacgctttacgtgcctttctgtatctccgggacgcccgctcgtattctctggtcgtccttctgcgttctggctcgcaatcatacttttctttgtattcctgcatatagttgtccagttcgctgaggtagatgtttgcacatatcggactgataccgctgccctgcggaacaccggagtaggtgcagttgtactgccattgttccatatatccggctttcaggaacttccagattagaccgataaaagcctcgtctgaaatccttttccgcagtaattcaaccaacacatgatggtcgaagttatcaaagcacgccttaatgtctccctcgacaatccatgtaacacctgtgaagtttttcttcacttgcgtaagtgccgtgtgacagcttctttttggtctgaaaccgtgtgaattgttgctgaatgtcggctcatagattgcttcaagaatcattctgaccacttcctgcactaacttatcatcagtagaagtgattcccaacgggcgaagtttcccgttctttttaggaatgtactttctttttgcaggctttggctgatatgtcctgttgcgtatggattcaataatccggttaattctcggcaggctcatgttgtccagcgtctgcccgtctaccccctgtgtcatgctcccctgcgatttcgcaatgttcgcatatgcaaggagatagaactctggattgtataggttgcgatataatctttcatatttgttgttacttacacttgccttttcttcaaggcttttcaagacatgaatcggatttctcatagtgtctcacacaccatcctttctgttttgaaaatgattcactgttcccctttgccatgtagacggctttcccgtccgcagactactatgggaactctgttgccatggtgaatattcagaaccccgcatttcagcgttttcatagcctttcggcatttcactttaggcaatccccgtttagtacggtataaacaagcgttccacgttgtcggtatgtgacgttcgcctttttccactttcccgtggctgaacctgctccgagtatcagcagccgcatagccaaacaatgcgactgtcaggaacactgacgagtacaacctctctacgtcaggggtacgctcttggtcccgatttcaggctgtcattcaagcagtctagcttccatcctcatacgtggattttcattccgtcacgccggcgcttctgaggcttcagcgccccgtgtcctccgtcatgctatggtcgccctccagtttcccttttggggtaagacggggaatgataggttgcggcacaatgccgcttgatacttttacctactacttgctcaaggtaggatttataccgcccttacgggcgcactcggtttcagccagaaccgggtcttaccggaaccggagccgccaatcaccagcacatttttgtttctggcagtcttggggtctttgggacggctgttcatagtcaggctctcggttttcgtcagaatcacattgttctggaacaccgggtcgatgtaaggagcgatgtcctcatgggttccccagcgggcagaaccatactccatgccgtggcgatactttttggcgttcttgctcttgagatagaccgccagccgcaggccagcaccacagcacagacccaccagtaaatccagcgggtgcaggctgggccaccagcttgccagcgccaccggcagcgtggagaagaacgagagcatttttgccgaagcgtccgcgccctgcgccctgcgccatccttctccgaagttggtggcaaacagtcccatcagaatatacggcaggttcaaaatcaggagctttttgatgtcaagctgctttttcatcgttccagctcctttcgcctggtgcgatccaccacggcatttttgaccagctctttgaactggttcagctttgccagcacagacggacgctctgttttctctgcttttttcacttttttgccggtgtactcagtaaaggcggcggtcagcgcatccgcatcccgacctttgaaaaagatcaggtacttgggcggggaggtgctgcggtcttttttcaccgcataatccacaccgtatttccgggcaatcttttcaaactccttgatggaggggtcggtgatctcaatgttggatacgccctgattctgccctacaagctgcttgaccgtctgcttgccctggggtttgactgggatttcccgttttcgctgcttattcagcttcttttccttgcagtgggcaaggtatttacaaatggcggccttaaacagccgcccggtgaactttgtgccgttgactaccagcgttaaagtcctgttttccacttcttcctgcatgggataacgcctcctttccgcagattttgcagggatgggtcagaaaatttaaggcggaaccaccagccgccgcagaagataccgcatcatcatatcatcagcaggatgctgtcccgcagctgggcaaaaaagagcttgccctggggcgttaccagtgtataggagccggtatgcccatgattgcagtagtccttaacggtaaacaggccgtcgttggcaggctttgcataaggcagcacattcccggacggggcgcggtacacaaaccgctgttccagcaggaatcggacaaaccggcgctccggcacaaccagttctttggcggtggtgcggaggttggtgctgtgcttgaggtcgataaacaggtcataaaaggctgccttgccctccagcatggcgttttctttccgcagcaccgcattttcctcgcgctcggccagcaggtcggaacagagtttcatcatggcttccggggaagtggcaacctcccacagcttttctctggtgatgtaagccccgtgttttcggatagagggcagcacctcatcaaatacccagcgttcaaaccgttccgcagagggcagcttgctgtgaacgattaggcggtacacatcgccttcgggaataaatttcattcgctgaataccgccgttagaaggggtcggtaaaacgcagacccctttgcagtgggctgtgatggcatcagcggtacgttggtatccaagtgctttcgcaatatcctttccgcaaaacagcactttgccgtcctgctcaaaagtgcggatactgccgaactcctgattgctgaaaatttccatctgattcatagcgtaacctcctgtaaaagacattgttgtgggatgaaaaaagacggccttaccagccgcctgcgttcatatcgtgattgacctgtgaagtgtagtggttgctgatggtggtgggagcgttaaacagcaccgtcagcaggtattgcttcatgttgcggacttcggtggtgtttttctgcaagctgtccatgacaaaccggatatgttcgctgtccagcttcaaaaaacgggagcgcaccacctcatggggaaagtcgctgccagcgatccgggtggttttgcgtctggcacagacggtttccaccatcagctccacgatctcgtccaaatcctcccgataggtagcaaactccctgcacaggtagtcatactcaatgttctctaaaatcaaatcccgataattttctatctcggagactgacatcgcatcccttcctttccgttccggcagtcttgccgccgttttctcccggaagggaatagaatcgatacttgatccatctgttattattttttgagtattggatttctctatatttaattctgcgggcttttccgtatccggtttctccatatccgggttttccgtatctggtgaagccgtatccggctggggcgtatccgggttcttcggctgcggttgctcatagatgacatactcggtgtcgctgatccggccctgccgatcccgcagttgatggcgtacaatgtacccggcagtttccagctcccgcagcgcgccgccgatagcgtccacgccctccttgcagattttcgcaagccctctggtggtgtagttccagtcctccggcaaggacagcatcatggaaagcagccccttggccttgagggacagcttcccgttgcgtaaatgatggttgctcatcacggtataatctctggttcgttcaatacgaaatatggccattgacctcactccttccaaatttctcagggtatgaaaaacgccacactcctgtaaaaagaattgtggcggtcacgatttctgttcttttttcctgcgccggtaggggcgcttaggcatgggcggtttatccagcaggctattcctctgtgaaaacgggagcgtctggaaaatgcggtcaatgtcggcggtttccatatcatgctgggaacgacaatcctcccggattgcttcccggatttcctttacagtgcacatttcaatcctttcctttcgcagtaatggcttgtttatgagtggcggcggtgcttgtccggcttaaaatcgaggatgtgtccctcgatgatacgggcgtgccgcctgattttgatttcccgacgcttctggcttacgagggcggcctgatagccgtcctccgtaagaaacagccgcatttcatcaccgggactgccgtaggcgcaggaacgcaggacagaaaactcaatcatccggcgagtgttatcctgaaaacgctccacggcaagaatgttatgtcctttcagctcacgggctgaaatatccctcataggctgctcctttctcagcgttcatgctgttgctggcgttttttctgccactgttccagcagcttgataatggtttcctgcatcctggccggagtataactcttgggaaaatacttccgcaaagtgtccgaagtgaatgtcaccttgtccagatcgcttttcttttcctcgcccataatggcccgcatcacatcaatggataaacgcccctcttggctgaacttcttgagccgctgggcctgggagagagagggggtggcctgttcgctgtccatcgcgtccaaaagctggatctgttcctcttttttgaggaaagacagctcgtaggccggattaaaggcgattttcttttcatccaccatatccaacagttcgggaattagctcggttaatcggatataacgcatgatctgaatgccacttttctcaccagcatctttggccaccttgtcacgggcactcaacttctgttcgacttgaacagaagtaaggtctgttcttgctccctgatgtttgatggcctctaacttcatgcgataagcccatgctttttcactgggcataactttctcgcgctggatattggcatctaccatctctataaccgcttcttcatcggtcatatccctgataatgactggcatatcctccaaacctgccaactcgctggctcggtggcggcgatggccagaaataatctcatagccaccatccgggtcagggcgcacaaggccaggcgcacgaacaccgcgctttttaacactatccagcgtttcctgcatcttggggtcatcatccttgaaacggtaaggctgacctgtaaatggcacctcggtctgcatagctggataccctttaaagtagtgcaattgtgtaagggggatacggacaactctctcttcgtcggcttcctgacgttcctgctccgtggtaaaaagatcatctaccgatgccagctctacttttttcgcgctgcttttcaagtttcgtcacctcctgcgtcagatttttgtagctctcagccaccttgccgccagggtcatgggcaaaaatgctcttgccctcggcgctgatttcctttgccctaacagaatggggaatctcggtggcgaacaccttgattttgctgccgtaggtctcccgcagcagggcggcgatctccttggcaaagttggtgcggttgtccaccatcgtcagcaggatgccgtcaatctggagtttggggttaatctgtcgcttcaccttatttactgtttggagcagctgttctaatccttttgcgggcagatactcagcctggacgggaattatgaccctattggcggctgccagcgcattgaccgtgagcatacccagggagggctgacaatcaatcaggatatgggaatactgtccctttacggtgtccaggtattgccgcaggatagtctcgcggctcatggcgttcaccagagaaacctccatgccggagagctgaatgtcagcaggcatcaggtcaacgccttccgggtggtgcaggatgccctcaccgggtcgcagcggctcgtccatcaggatgcgtcccatcgcgtcggaaagggtaaagggtagcttgtccggttggggataacccaggctgatggtcaggctgccttgcgggtctccgtcgatcagcaggactttcttcccagcctgcgccaaaccgattccaagattggcacaggttgtggttttgccaacgccgcccttctggttggcgatggcgatgatttgcgtgttcattgacttcacctcatttctgattgttgctgttgcttctggaaatagaaaaagccgccactccaaaattaaaagtgaagtgacggctctttctatcgccggaatacgagttcttgaaatgaaaaaacacccagtcattttacactgagtgctgtatcaaattcatattcaattatccaaattaggtcaagctatgccaaactgccacagcccaaaacaaagggaaggagagctgaaaagcgccccaaaaacaccgcaaaaatcagctctcggttgtcctataatttaaccactaacccctttttttacccccatttttgccggttgtcctatatttaaccacggaaaattgggtgaaaacggctctcgttttaccaaatttagtcaaactatattagcccgtttagatatagtaaaaccccggaaaaccttgattttccggggtttttgaaccattttgatacggtttgaacagcagattatctcttgctgaactgaggtgctctacgagctgccttgagaccgtacttctttctttctttcatacgagggtcacgtgtcagatatccagctttcttaagggtaggtctgaactcagaatctgcttccagaagagctcttgcgataccatgtctgatagcgcctgcctgtccggtatatccgccgccctttacattaaccaggacatcaaacttgccgtctgtgtcggttgctgccataggctgacgaacgataactttcagagtctccagtccgaaatactcatcgatgggtcttttattaatagtaatatcaccttttccaggtacaagatatactcttgcgatagatttttttcttctgccagttccgtaatattttgctgcgttagccattttctatttcctccttaatagattcctttggattaaaatgtcagtacttcaggtttctgagcttcatgcttgtgatccggtcctgcataaacgtgaagcttggtgtacatctgtcttcctaaaggtcccttcgggagcatacccttaacagccagctcgataacctgttccggtttcttagccattttttctttcagggtaacttctttcatgcctccaacgtaatcggaatgatggtagtaaatcttctgatccatcttcttaccggttacctgaatcttctctgcattgattacgattacgtaatcgcctgtatcaatatggggtgtgaactccggtttgttctttcctcttaaaaccttggcaatttcggatgccaggcggcccagtgtctggccttctgcatcaacaacataccattttctatcaatcttagccggattggccataaatgtcttcatagtatacctccatcgatttgtacggattttggatcttctgatccgcatgactggctcatgtactcaccctgggaattggggttttccacatattatttatatcaaaatgtctttccggggctttggtaagacatttttcaacatcgtcacattgagttattatattatacggatccgcgcgtgtcaatatcttttcttaagaaaattcgcataaaactggcctttttcaccataaaacagggccttttggatcatttatccatctgaacggcttccgaggacctcattccggatttttccaatggaaatgtaccgttccagaaccgcttccatatccgttccctttcctgccgtctgtgctgctttgccggaaacaaaaaggcagaagctcttatcttcccgctcttccacccggtaatcatccatgaaaaaaggaatcctgtccggaatacggttttcacggattccctgcagttcttccggagggcagccggggaagtttacattccatatttcatcttttgcgatttcctttgccaaaatctttctgaccaccgacagcagatgggtatccgcagccgcgccgcttcctcctctttcctccgaaaaggcaattgccggaatcccattaagcaaagcttccatcgcggctcccaccgtaccggaatacaatatatccgctcccacgttatagccgcagtttatcccggaaaatacaatatccggcttttgtggcagaagatactttatccccaccttcacacaatcggcgggagttccgtccacactgtatgccttcactccggggacagggaaactttcttctttcacatgcaggcttccccgaacggttatacaatgggacatggcgctgcactgatgtctgggagccaccacccatacctcacccagctctgccgccattccggcaagcctgcggattccatcggactcaattccatcgtcgtttaccaccattatcctcataggccgctccttttcatagtcagaagtgcagatacattcgttttcattcacaatatttcctgccgttcaggtgaatccttcagttcagggaattcataagaaatcaaggtaagtcctctggccggagcggtaggccctgccgccgtgcgctccttcgccttcagtatatcggccactgtttcgggcggatattttccgtttcccacatccatcagagtccccgcgataatacgaaccatattataaagaaagcctcctccgctgatccggatgaccagctctgtcccttctctttgcacctcacagctgtaaatggtgcgtacggtggattccacctgggcatttacactgcagaagcttttgaagtcatgttcaccgataaggaactttgcgccttcattcattttcttttcatccagaggaagataggtgaaatgactgtacagccgtttcaccggattgggaaattcttcatttaagatccggtattcatacgtctttatgctgtccgtctttctgggatggaaggtgagaggcacctctctggagccccggatccggatatcctccggcagacgctggttcagggcataggaaaatttatctcccggcatacgggcctgtgtgtcaaaaacggcaatattcccgaaggcatgcacgccggaatccgtccggctcgcgccgatcacctgcaccggttccttcagaagctccgtcaggcacctgttgaggacctcctctatactgatcccgtttgactgcaactgccagccatgatagtttgtgccgtcataagccactgtcagcataactcttttcataactcatcccttcccgatttatggtatcagcacagtcagtacagctgccgccaggtaaagtcccagcaccgcaaaagcagtatagtccctttttttataaatcagcggtttcatctttgtcctgccctcgcctccccggtaacagcgcgcttccatagccatcgccagatcgttggcccggcggaaggcagaaataaaaagaggaaccaacagcggaaccatacttttcgccttcttgatcaggttcccgctttcaaaatccgctcctctggctatctgggccttcataattttatccgtttcttccagaaggatcgggataaaacgcagggcaatggacatcatcatagatatttcatgcaccggcacatggatccttttaagaggtttcagcaggctttccatcccgtctgtcaggttattgggagtggttgtcagcgtcatcacggaggaaccgataatcaggaaactcaggcggacagccatgaataccgccgtgcgcagcccttctttggtgatggtcagcttccacagagatatcagcggttctccgggagtgagaaacagattaaataccacggtaagaattaaaaggaataaaatagccttcattccttttatcataaatttaaaggggacatgggacagcttgatcatcccggccaggaacagcgccgccagcagatatccccagaaattatttaccacaaaaagagaaataataaaaataacggtcgcaatcagcttcactctcggatccagccgatggaccaccgattccgtctgataatactgccctaatgtaatgtctcttaacatagcctatttttccttcccatgcccgcaggctgccagaatggagtccctggcttccgtcaaagtagtggcgtctgtttccactgccaatcccgcttccttcagcgtctgcataatataggtcacctgaggggccgcgagtcctaccgcctccagctccttcccatgcgcaaatacctttttaggttcgtcgtcgaacatgacgctccccttattcatcacaataatccggttcacatagtttgccacatcttccatgctgtgagataccagcacgatagtcattccggttttttcacgcaggagggaaatttctcccaatatttcatcccggccttttggatccaggccggccgtaggctcatccagcaccagcatgtccggcttcatggccagtactccggcaatcgccactcttcttttctgcccgccggacagatcaaaaggggactgcttataatactcttctccaatccccaccagctccagagcctccatcgcccgggcctgtatttcttccttagacagccccagattcttcggcccaaagcagacatcggagaaaacatcaatttcaaacagctgatgctccggatattgaaatacaagccctaccttactgcgcagctccttcatattataatccttgtcatagatattctttccattataatagattgccccgcttgtcgccttcaaaagtccgtttaaatgctgtaccagagtggactttcccgaaccggtatggccgataagcccgatgaactgcccgtcctctatggaaaggttcacatccttcaaggccgccaccgacaattccgtatccgcgccgtatatataattcacatgctccagtttaattgccattttccttgctccctgtttttaatgcaagcagttcttttttcagttcctctgtggtaagaatcccatcgggcagaggaaggcccgcttttttcagttcatagcttaaaagggtcacctgcggcacatccagccgaagcgccttcagctcgtccacacaggaaaatacctctttcggcgaacctttcatcactattctgccttcatccataacgactacctgatccgcgtaaataacttcttccatatagtgggttatcaggatgaccgtaacattttccacttcgttcaatgccctggccgcccggatgacctccttccgcccgctgggatccagcatggctgtaggctcgtccagcacaatacatttcggatgcatcgccagcacaccggctatggatacccgctgtttctgtccgccggaaagcttgttaggggaatatttgcgatactcatacattcccaccgccttcaggctttcctccacccgttcccatatttcctttgtgggaacccccatgttttccggcccaaagccaacatcctcttccaccacctgtccgatgatctgattatcgggattctggaacaccattcccgccgtctggcggatgtcccatatattgctttcctccgaagtgatttttccatccacccaaatggtgcctgaggttggaaccagaagcgcattgatatgcttggcaagtgtggactttcctgagccattatgcccgagtatggcaataaaatcccccggcttcacctccaggttcacaccgtccacagcccggatagcgccttcctcatttccttcttcgtcatgcctgatataatcaaaggtaagttcctttgtttttataatatcctgtttgttttcgttttccatatgttatcctgtttcaaatattggtttacaattactgtcaccttcctattttactaaagtccacacagaattacaaggagaactattgcttgtgtacggataaaaaaagtgggtgccgccagggacaaaggttcccctcccgggggtaaggcagcttcgccgcgtcccttcccggcagcagccccggacagtcagtgattcctgtaaggggcgtctgaaaacgccagtccttacgctgcgtcttttgcagcgttagtactgctgcgtttttagccgagtgagaacgtcccctgtaaggaacactgactgtccggggctgctgccgggaagggacgcggcgaagctgccttacccccgggaggggaacctttgtccctggcggcacccactttttttatctgcattctattgcttgaatttctgcgcatatttatgtataatttatatccggctcgcctatggaggggatatcatgaatacaaaagcaaaaagaataaatgatttcggaagggatcacgtacccggccttgtactgcgggtatctgtcccgtttatgttcgcacagttcgtcaacgtcctttacagtatcgttgaccgtatttatataggaaacattccggtaaccggggccgattccctggcaggagcgggtgtatgcgctcccattatcaccctgctttcctcctttgccactctcatcggcatcggcggttccattttattttccatgcgtcttggccaggatgacaaaaaagatgcggaacggattctgggaaactgcttcagtaccctgcttcttttctccgccgttctcaccgtcgttttcctgcttaccaaaggaatgcttctgcgctggttcggcgccagtgacattacctatccctatgcggatatctacctgactatttacacctgcggcacttttttcgccctgctgtccatgggtatgaattatttcatcaccgcccagggatatcccatgcttggaatggtaacgaccctcatcggagctgttttgaatatcattcttgatcccatatttatttttgtttttcatatggatattgcaggagccgctgccgccacggtgctggcgcagctcgcttcctgcctttttgtccttttcgtcctttataaaaaaagcatgccggtcccccttcaccttcgccgtcccgaactgacgctggtaaaaaggattctggcgcttggcttctcccccttcctcattctggctaccgacagtattataatcatcgccatgaatgcggtccttcagtaccatggcggccccggctacggggataccctcattacctgtgccaccattgtacaaagctacatgatgctcatcacctcacccatgctgggcattaccggaggctcccagccgcttatcagctttaattacggggccaataagccggatcggataaggaaaatcattctgtgcgtcctgcttttatgtattggatttacatccttcatgttcttggtttcccgtttcctgcccgctgcttttgcaggaatatttaccgataacgccgagtatattgcgctttccgtgtggggaatacgcgcctttaccatgatgatcattcccctgagcttccagtatgtatttgtggacagcctcacggcactgggaatgacaagcctgtccctgttcctttctctgttccgcaaaaccacttattttgccgctacctgcctgctgcccctggcttttacggcagcaagcgctttttatgcagaaccgattgccgacggaatcgccgcccttttatcatctgctgcttttaccctggtgtatttcaaatatctgcggggaaccggcaggcttgtgcagatcggaatcgggaaggaaaaagcagctgcctgacctgcggatggtactgcataaacagtaaaaaaaaagccctgcggaatccttattgcaaaaacattgcagattccgcagggcttttttatcccatgcttttttatattaggaactcaaacttccatcctatgcctcattccaaagcctttccataaactctcttgcctgcaccgcattctccggtacggtatcctccagcgttgcatggatataaggcttatccgttttcataaagcggatcaaatcactgtaatccatgattcccgttcccgctgccatggaaacaatcttcccatccgacacactgaaatccttaacatggatgaccgccacatcttctcccagcacttcaatggcttccttcaccacatccttataccttccggcatcgcagtcatccagcagattcaccggatccagtatgatctgcagattcggcgactgaatcgagcgaagcacctgccttgccctgcgcgcatcgtatacgatgtgccggcagaccggttcaatcgctaccaccactcccattttttccgcatattccacaacacaggaaagattcttcgtaaacgtatataaggcttcctccgtgcggcttgccggatccggcacatacagggaattcggattgccggtttccgtccccaccacgcctgctccaagccaggacgcaaaacgaatctgcgccttgtatttctctattgtttccgcaagacgggctccgtcaggatccgccaggttcagataacagccaagcacagctacatccaggtcattctgtgcgaaaagcttttttaaatacatggcaaaaccgggcgtgagcgtggaattctttatttcaaaatcatcaatcaccttggacagcgccacatgggcacaggaaaaaccctgctctctggtatgggccagcctctccggcagcgccataggtaatgtatcgtgtaagcgaattcctatctgcatatctcatctccttacgcttcagatacgaagcattttggtggcatagggctccagctgcgcttccaccggcccgtctgctgtctgtatggttgttgtctggagcatatcgctgttgttaatgacaaccagctgtccgctgcccggataataagcgcattccgtacagcaattatccgtcaggtaaagcccgttcctgtcttctcctcccgcaagcagaatcaggttgagaagcagcctggtattttctatcgttttttcaaaagaagccatataaattcccataccgctgccgaacttgttcaccgtcagggtaggaaccccgccgtcctgtgcgagaacctttgcttttccatctgtgaggaaagggatccccttccggtaattgccggttttcttcacaaagctgccttccggcataagcccttcctccgtctgtacctcaaattcccatttcccatgacagatacgcgctccggtatcttcgtcaacgcccagcacaggagccatgcggaaaaaggaatcatagccatccaccgcggaaggctcatttacgccgataaagcttcccccttcatatacaaagcgggtcagtttttcaacaacagccggattcttccatacatccccgccgctccaggcacttcccgcaaatccggcgttgatcaccacatccacgttttccagagcgccgtttaaaacgtcctcaaagctgataaaggatacgtccaccggaagtccggaaagggcttcattaatatgaatcaggtcattcatataggtttcatggaaatgaccggaaagcgtccaggaacggagctttccccagtaatgcagcacagctgctttcgtacggatgctgtagggcctgccttccttgtggaattcgcctatggtacggaattcatccgccacctgctctatataatcgcagaaatccggatagtcttccaccagatggagatagcctcccagaccaatcctctggacaggttccctaagaagggcccttctcacactgttccaatatttttttgcctccagtgtggggtctccgccgtccataaaggtaggcgcgccgcccagtcccacagggaacagatagggatgaagccgcagctcatgggtatccaccttcacccctgcgcagagcctggcctcgaagccggagaacacgcacttgatcagcccgtcaaaaccgaattcctcaaaccttccgttataaggctcgattcccacccagctgtcatcataaaaaacataggcttttttgccgtattcatgtaccatatcaatcagcttccggccgaaggaaattacaaaatcattgataaattccatccagtccgcttttttccggctgcccggcatatgggtcacatgcagtttcccctggttgatgaagtcctcggcagtcagttcatagccatatttcgcggcaaaatcatccagcgccttttcgctcaccgtaaaatcataggagccccagtccgtaaaaaggttcctgttcctgacatcgcttccccatatccatacaaaattataaaacatggaagtaaaacgcacaacagtagtggccggatgggtttcacaccactccttcatccactccagcagaaattcctgtgtctgagggtatatgggatcaatctgcatcaggtgctctttatcccaattgttggtagtatggttatacatggaaatttcttcccagatacggtaggccataaagctcaccgtataggaatgccaggcggcaggctcctcaatggtcacacagcctttttccttatcatagctccatttatccgcagccagcagcgtatccgtggttctgtcatatacctgccagtaccggaacgccctgtcgctgtcattgacggaaaactgctcctcaaaaaaatccttcatcagttcaatggtgagcttcccttccgccgccaccgccgggcttgtcataaggaagcactgctgcagcttatcatggttcttcttcgcccactcattatgttcccggatcatacagatagtggagtaaatcccatatcccgcatccagtatttcatcggaaagctccgtcccgtcactgtcacgtatgacatccgccccccatttttccgccagctccaaagtcagcttttcgtagcctgattcccccggcagcgtaaagctcccttttctattttcactcattccttcatttactccttatctcaggatttatgtatataatcctcccggatcattccgattgcataaaattataaagcgccgtcctttgccgcgtcattggctgtgagaagtccggagaaaaacgccagcgtcaatccctgtccccagccctgaatccagcgcctggaaatatccctgtacccgtccctgtccttcataacggcggttcccgcggatacattcatcacctttccatccttacccacattttccagaatccctttcacggctttattgatatatttggaatgcagaggatttcccttttccagcatggctgcggcgatacctgcggaagcggatacttcctcataagagccttcatcgtccagaatcgtcctccataacccgttttccgtctgcagcagcttcagcgcggcaagctgctcattcagtgaaccggtcacctccaggtatttggggtatagataagcttccggaagaatgtttcctacctgcgacatggtataggcagcccaggcgtttgcccttccccagtaaaaaccggacatgtggccgccggtaatattattatagccatggtaatataaaccggtttccggattctgaagataatggatgtgccagtagtattgattcagcgcatcgtcaatcatctcggcattgttaagcttcacgcccacgcgaagcaggaaaaaagccgccatgaacagagtgtccgcccaggcctgttccggaaaatcattgttggcagacaccgtatgctgaagcacatggtcaccgaaccgaagggcatcctcctgcaggtaatgcaccttgctcatcacaacattccagtatttttcatccccggtcgcttcatataaggtaatcagacagtgtcccatggcgcaggtattcactgtccactgaggcggcagtcccagctccatatattcatcaatcctgtcctttaaaagtgtcagatactcttctttctttgtaacctcccaagctttggatatgccgtaataggccacaccgcagggccagtcccaggtcagatccatattcatggttttgtgcacgatgcggtcgatcgcatcctcaatttggttcctgtcaaaatccagctttaacatttgcaccctctctttctccggaaaattccggtatgcatccctattatgcctataccttaaaataaatcgcttccgatttctatttaatttgaatgatatactttgcaatttcaaccatttatgatatatttttgttagcttttattcattattttaaattccatcggaacaattccggaataggatccgttaatttgtatattattttaatctttcttctttttctatggtttttccatacaatttattgcaaattttatttgttacttttttaacatattggttgtaattattataaattcctgtaaaaggaggccgtatatgtccaaacccaaaaacactgtcatggaataccgcaactattatcttcctggggactttccggttctcgtccttacaggcggacattggaaaatatcggatattcccagcagccgtctccattttcacaactgcctggaaatcggcctctgccattcccacagcggcacgatgaaattttacagcgaacccatgtccttcaaagaaggggatgtcacctgtattccccggaatatcccccacaccacctactccgaccagggaacggaaagccgctggtcctatattatgtttgatcctgcgcagcttttcaggggcctcttcctcacccccgacgcaggccccgacctgtccctgttttcctaccggaattaccggcatatcctgccacgggaggaataccctcatatccactatctgacgctatccatcatccgggaaatggaggataaacggcccaattaccagatctgcgtaaaagggcttctgctcgccctctccatcgagctgaacaggatccaggaagaggcaagtcaggagccgggtgcagaagcctctcacaaagcctatcttcctgaaaacgccctcatcatttcacctgccctggattatatagaggataattacagcacacaatttcccatggaagacctggcggacgtatgccatatgagcctcacccatttcagacgcgtatttcatacgatcatgcggaccagccccctggattatctgaacagcacccgcatcatgaaggcctgcaacctgctgctcagtacggaggaatccatcctcaccatatccgaaatggtgggcttcgcttctgtctccaatttcaaccggcatttccgcagtgttatccgcatgacgccccgtgaataccgcagccggatgctccttgcccgccaaaaagaagggaacgactcccggcagaccatcctggaatttaccggatggatggagccggaaaccgatccctcttaggatatgcgccatcgtgcgcgccgtatattacttataatactccttcaaagcttcttttaccgcataataggccggtttgggcctgcattcggtatccactatcccccagtagcattccgcaggacagtccgacgcaccgcagtgatagcaatgataggcatcccgccagcagaacatgaaagaaccgaggcaatgcggatgttgtgcaaaaatacggtgtcctctcttaaaataatctgcctgcacctggggcgtatgccctccttccgcctgattgaaccatttctttgtataacatacttcattcagcccttcaggaatcaacgccggatccggcgcctctgtctccagctccccgtcggaggaatacccccattcattcgccagtacgggaagcccgtatctttcatacagaccgtcaattaccccgatccagtcatccacatctcccggctgccaggagccaaaatattgatccactcccatgtaataaaaaggatgcccttcccggtaaaccaagtccgcaattctcaccgcattttcattatagcaggaaatattgatgccgcatctggcctgagggttggctctccgtattccctccgcgctggccctggccgtgtccgccagaatatcatccggataatcattggaaaagaccggtatgtcaatttcattcatgcactgccagtatattcccgcagcttcccccagatcctcacagataaaacgcatggattcccttacgttttcatagaattcatcggtccctttcttaccaacgaactcaggaaaatgctcatgccagcaggtcttcccttctttttcatcataggaaaaaccgccaagaggaggggttgcaggcatcacctgaaatcctttggcatgagtatccaggatttcctgcctcgcctgtatgtattcctcactcagggtgccgaacattttgtcctcccaggggaagcaaatattcagccgcatccattccaccccaagctcctttaccatttcatattctccgcttgtattatacgcaaaaacaatccccttaattttttcagatgccttcataccccagattccctccatcttcttcaataatggaaagccatgccagctccgctccccagtatgccgccagctccttttccctttcagcttcttcttttcgtatatgcataaaatttagcgggatgtgccttcatatgattggccttgcgcacgtcatgctctcccggaaggttggaaacaaaaccgccgaaatagggaagtctgtcttccttctccagcagcgcatccgcaccctccagcatctgacggtataaaatagcggcctctctttcctttcccagccgccgcagtgcacaggccgtataaaaatcgctttcatccagacgccctgtctgataggccgcggctttttcataccaggccaaagcctcttcccctcggccatccgcctcaagagccttcgccatatggtaatacaccgccgcttcccgggccatgacacccctgccctcatggtaattttccggatattccagcgctttttccagaaaagctatagcatccttattctttccttccctcagggcgcgtcttcccagctgaatataggctaaaatatgggcctttacaaggattccctctccgccttcataaggattgaaaatacgctttttcaggaattccgccgctttttcaggcattcccgcttcgttgtacagaacaagctgctgatggtacagatcctctcttttgtaaaccaaatcaggatactcttccagcaattccagaaggtttctcaccggtacgccgcactgcttccgtatttccatgagttccagaagataccgcccgtcggggctgggagaagaattttctcctgccgaagaagcccttttcagggcaaatgccttctccatttctctcctcgcaccagttttatcccggcatacctccaggagggcaagggcaagacatctgtgggcctggtaaagcccgtcctctctggacaccgcctcctcccagtatctcattccttcttccctgttgtccctcccataatacagacagcccagataataggcgctgcgtcctccgtcaagcccacgggagtacgcgtattccaacactcttttatccatatccgtataagggaagcaataatctccgggatccgctcccgcctttttcaggaaagccgccgcatcctcctcttttccaaggccggccgccgcataagcgcagtcatagtaaaccatgggatcggaaggcgccttctcaccgagcttcagcacctcctcccaggctcccagttccagataagaagccatcagcacaagccacgccgttcttcttttccccagaaccgcctgcagtctttccaggccgctttctccctgcaggaaccaattttcccccaatgacccataggccataggatcgattcccagcatcctcccggtcaccgcctccgcctcctgcgtccttccctcttttcgcagcagaaaagcctgcaggaaaagaagctccgggctttctccgtttacagtcagggcctcccgcacacaatcccgggccgccccgatatcccctcttcgaacagaaagctttgccgcctgtttcaggcccgcgcccttatagccataattccaggccgcctttctgtaatagcggacagcttcctcctcctgcccgttctcttccagcgcccaggcataattaaaacaatattccccgtccctcggattgggattgcgcagcatacagcgcttcaccgcccgttccataaagcgcagggcctccctgctgtttccgcgccgcatcatgagaagtcccatggcattattgcatcggctgtctcccggatccctgcgcagtgcttccatgtaatagtcctgtgcgcgcagcgtcacatggcggtactgctccaaatgcagcccttccagataaagctcttcctggctgccaatctccttcggctcccgggcaggcttatggggcacgggtttctccctgttttcaaaaaacggcgccctgcaggtataggaaatcagctccctcccgtcttcatcataaagaaaggctgatacctccttttcctccatatcctccggtacctcaaacgttctgagcacaggcctcccgggttccagggaaacttcttcttccacaagcgtctccccttttaacactaccttcatccgggcattttcacggacagccgtgacattaaagcatacctccaggctccgcccttcgtgcacaaagcccaccgctccgtcttttccggcatttttcaatcccggcatatccgacagggcataccatgtctgctcaaatgtctttgtctcatccggagccataaacgagaaatccggctgattatccgtatagcagcctgtcatgatttccagataggccccgtcctcatccgtcaggttagaatgccatacatctccgaattcccggcttccccatgtgaagaattttttccctacggatacatgatggtccgccacatgtactgttcccctctttcttccgtaatcatagccgcccataaaattataatccgaattcaggatgaaaaaggacgccggcgaaggaatattcttaaaccaggtgatatccgtcccttccccgaaatccgccctggcaaattcccctctgaccaccgggaacggagagaccgcatccttataatggtaagtaatgtagtccacatccggcgggaactgcagctggtaatcctgattggcatgaaccgccagattggcccaccagtgaaaggtctgcatggcgtttgtaggattatacagccttgttttcaccgtcacataggctttgtcgggccagatagtcaccccaaccatgcccttcatgccgaataaaggttcatattcccccatccatgcggtttctgaaccgtcttcccccttctcaatccaggaatccacaggcataaaggtggtgggacggtgatgctggggccagttaaattcaattccccctgaaatccaggccccgcacaaaccgatcagcgccggttttatcacattatttttataaacaaaatgatagtccgcctttttgtcatatccctcatatattcttccgcccagctggggaagcaccgtcacccggatgaattcattttccagccggatggcatcatattccctgtccgtcttcacattcttaaaggtatctgtcatcgggatgggatagatattccctctggttccctgatgatttctcacatcatagaaaacaggcgccttctccgcctcatccatttcatacgtgggaatcaccagcttctgtctgctaatcatgtccataccccctttgtccgcttcagcggacacctttcccctaaaaagcaatcatcgctgtccgctcggctttttcctccgcaggcattttctcccctgccgccacctcatagagatcggcgccgcatgcctttaccgcctccatcatctccggatagggctgggaacagatgtcaaataagccgatattatagttttctccgtcaaacctgcccagtacaaactgatcatagcactggaaataatggcatcccaccccataaggatgcgccgccgcacgctgacagtaatacttataagccagtcctctgtcatattgggaggcaactcccttcagcccggttgaactgggccctgcatccagggctccaaaatggaattctccgatcaatacgggaagatccactcccagatccacaatatttcggatcgccgctgtgggatcataagcataacagttaatggaaaacacatcgaagttctcccatcccgtaaccacatccggatcggaaacccaggcccagcgcattcccagattcatatggtcaggatccaccttccggcaggctctggaaggaatccccacatattcctccatcatcttcctggaaaaagcatgcatatcccgcccggcacgttccgaccattgagacacatgggcctggctttcatacaaatcttcaaactcctcaaagctgctgttccacgcgccattcagggcctctatcgtctgatattccgccttcaggctttccaccagcctctccttacataccgtcctcacaggattataaagaacctcatccgcgatcaccagattatccacgaacgcccaggccggctcattccgaaggaaataccccaccatccagggatccctgctttttgcctgcatggccttcgcacattcctcagcatccagccggtattcctcactgaacacatccgggaaatccctgaaaatattcttctccgtccccggaaaccgcggaagcgaagtaacataaggcatccccgtagttccaaacagcctgtcgtcactccagttccccagagtattcatcccatattttctcagctgtccgggaagcatacgcttccactcctcataccatccctctccgaaagccctgtaaagatttgcctgttcaaaagaaaacagcgtacatttccttctcgcctccccgacaggcggccacttttcatgaagctcatacattctgccatacacaggatcctccctgtccggcagccaatccatccatttctccacgccgtccacacggcagtcactgcgcgccaccacacaatccggccccacgctgaaaaaagcataccccagaggatccaccagccaccaacgcccatcttccttacagcgcgtaaaaaatcccgttccctcagccagtttcttctttctccatccgccatattccgtccagtcctcatacggataccccatatccgcctccccggcctgacgctcaagcatttccttcatttccccgatactatgaagcttactcccccactcctttctcttattctgccccagctcatccaccagcttcacatccggcagaggaaaatctcccggccgcgtatccgtcagggtaagctccgaaagcttcagctccgtctcctcatccataggaagcgctgccagcacaatccggctgatttcctccctgtccacccgtctgccctgacacacgattttcagctgccccggacaggtctccggaaaaagcgcatgcgcatccagccacgtcagatccacacagatccccgtaagaatccgcggaagcaccccgaaccggacaccaaacaccggctccccgctctcctccctgctgctatacaccaacagattaaccggcacactatgctccgcttccgcctccaaagaaaagaccagatacctctcatccctctccttcagccaggtcacatccagtcctccccccttctccggcacccgcagccgggccattcccccttcatctcccagccaaacagccccatccgtcagcatccccctgccaaccgatattttctccataaaaatccctccctttctttttagctaaatggtaacttgtaaatcccctcccaccccgttccccgccaggtccccttccagctgcgtattttggggccgcggtgctcttgctcctatagacccgccaggcagtatcccctgaaagggccgtttaaaaacgccggtccttacgctgcgtcttttgcagcgttagtaccgctgcgtttttaaccgagcgagagcgcgcccgctcaggggatactgcctggcgggagctataggagcaagagcgccgcggccccaaaatacgcagctggaaggggacctggcggggaacggggtgggaggggactcacaacctacactttatattctaaaggagcccgtgcatttttacaatacacggactcctgtcggggcagtatgaattttactgttccctgtcggctttgatcgcgttgttcatctcaaccagcttggcaacatcatctgcctgcgcaacagcttcatcatagaaatactggaatacttcatccacatgataattcttctgcagttcttcaatcattttagtacggactgcttcaaattcttcatcactcttggcagcaaccgcggtaaccacattcttgcccatataagcattgatttcatttacataagaagcgatatccccttccggatccccgaaggaaatatacattcctgcatcggtaacgggtgtttccgcacgatatacatcggcctgggattcctgtccgtaatgggaaatgaaatccttcaccgtatcattcatcttggaatccagtgccttctgggagaactgatataaatctatggcaacaccgtcatccggatcgattgttccgtttccgaaaccacagaaatgatgatatacgttcactccggtttccacgccaaaagcgtcatccttcgtaaccttcagataatcatccgtaggaacggcctctccgtcctccacattccagaactgtccttccagaccgttccatgcgattcgggagaattcataagtggacacgaagtcaagcagtgccacgcatctctccggattttccgtattggcatttaccacgtactgtctttcgccacggtacatatttccgaaacggtcttctgcatcaccgcttaagctgggcatggaaataaatgttttctggttgccttccgtcttattaaattcctggttcgcatttcctgacatccagccaggtacattgaacatatattttccggccttcaggttctcttcatagatatcggaggtcatggtaaaggagtccggatccagcaggcctctctggtttgctttgttataaaagcgtacagccctccagaaaataccttcgggatcggtcagctggttattttccagcggcttggaatccaccgtggatacacccagaacacgtccggttgtttcaatcaggtttacaccctcctgaggcccaaggccgaatgtaaatacccattcaccccagccctgtcctgcgccgaaccatgcaccgcagccataggttttctggccgtctgctgtttcgggttcaagcgcctgcatggcttccattacatcaagcaggtcttcatcataggattccagtttgggatagccggcttctttatacagatcccatctgatataatggccgcaggtaggtattgtgccgtcatcccaggagcccttgcacattccccacaggtaagcgttcccgtcagggctgtttgccgccattctctgagcttcgatcatcattttcccggcaggatcattcatggtgttgggcgcatactcttccagataaggctccagattcagtgcggaagccgattccagcagcatgggaagctgctttgtgggatcggataacaggaaaatatccggcagatcgccgtcagccatcatcgcggacagctggctcggccagtccgcttccgtaacccctgtcagatacaggtcaatattcagcgtgtcttcaatatacttggttacaggatcgcttcgtaatccgtccgcttcccctcttcccacaaacgcaaccacatcaagggccacacggtcctcaaaatgaggaatcaccactccggaatcagcggctgcctcatcggttcctgccgcatcccctgcggttccctcttcagcttctgcctgtgtggcttctcctgttgccgcagcggaaccggaagcgggttccttcgatgaagaaccgcaggctgtaagtccgccgagcattgcaacggtaaccaccactgccagcatcttggttacaatattctttttcatactctctcctttcttttcaggcgcaataacgccccttccttacttatggaatttcattgtctgccagatacctcgccaatacagcaggatatccgacccccgcgggaaccgcctgtgaaatgtgcagacacattttcccggctgccgtccgcaggaatgaaagtaagaacttactagccctttacagcccccagcatgatacccttggtgaaaaagcgctgcatatagggatatacacagaggattggcaccacagtaataaagctcatagccatcctcagcgtggtggaggtgaccttgacagccgcccccgccgcggctccggtgcctgttgttgacaccacattggactgcagcttcgtgtacagcagatattgcagacagtgcaggttggctgccttccgcccctgcataaagaacatatcatccgaccaggtattccactggttcaccgcggcgaacaccacaatacatgccagaatcggctttgccagcggcaggataatccggaaaaacaccttcaccaggcctgccccgtccatctccgccgattccaccagttcaccgggtatggactctatataggtctttatcagaataataaagtaggcctgcacggcatacggcagtatatatacaagaaaattatttttcagcttgatattgctgattaacaggtaatagggaataaaacctgcattcacatacatggtaataatgaaaaatcggtacagcagctttctgcagggcagatcccggttcgcaagaatatatgcggcgaagctgcagcacatcagggtcagcagcgtacccagaatcgtacgggcaaatgcgattccgatactggaggtcagcccggggatttccaacaggttcgtgtaggcctccacggaaaactccctgggaatcagatatacaccccggttcactgccgcaggtgaagaccaggagttaataaatatgtaccagagcggataaacacatataaaagtaaacagccctaaaataagagaatttattataccggcaaaagtaattctttccttcttttttttattcatatcacagcttcctttctccaattctgtccctttttcgcaccgcttagaaaatagaatcccctctcagcctcttggatgcccagttagcaaaggaaagaagaatgatgctgacaacggatttgaagatacccattgcagtcgccagggaatattccatattcttgatacccatccgatacacataggtatcaaatacctccagcttatcccatgtcatgccgtttcctaacagccagtactgatcaaagccgttggaaagcatattggatattgccagaagaagaagtacaaagaaggtcgacagtaatccgggaacggtaacgtgaacaattttctgccaggtattggcgccgtccacatccgccgcctgatacagctcctgatcaatggaagttatggccgacaaataaataattgcgttatatcccagtgtcttccaggcaccgattgccacctggataaaccaggcatgctttgcattagtcagaggatttaccggttccttcaccagccccagtcccatcagtatattgttcagggcgctgctttccgaagacagcagcataaatacgatagaatacaccaaaacccaggatatgaaattggggatggatgtacctgtctgaaccatcttggcataacgcttatttttcagctgggaaatggcgattgcaaaaatggcaggaagcacagagcagcagatattcaggaaggaaatacacagggtattccgcatcacattcaggaaatccttgggattggcgacaattttctgaaagtacttcagtccgacaaattccgaatcaaacacggacacgcccggcttaaaatctacaaatgcgtaactccatcccagaagcggggcataattaaagatcagtacaaatatcatgaacggcagcagcaaaagtacaagacgtatttttttcttctgccttcctgtcagttgatttttagctttacctgccgtttgcatcatatatctcccgctcctttcttactatccggttcctcaatctgcgccacaggacttacacggaagcagggttcttccacacaacggtctttataggcaaagcccctggcaataccttccacgttgttataccagtttcccgtcacctcattgatgatgtggattccgtcaaaggtctcctccatctcaaaaagcagaatacgcttggcttcatgcctgttgggacaatgcagcgccatcatcagctgtcccccgaaggtggtaaacagcatggaatgcgcgccgtccatggcatacagcggttccgtctcctgaatccaggggccctggatatctccgcttaaggacctggcataaccggtagtatatcctcccttttccgaaaagctggaccacagcataatcagcacaccgcttttcagtctgtgaagaaaaggtccgtccgttacccatccgctgttcttcatcacttttgcagcccatggcccgtccgaagcgcggaaaagaatgacaggttcgcctatggcctttcccaaatcatcactaagaggtaccgcacaaatctgaccgtcatttacctggagccactcatggcagaaaaccatccagggcctgcccttcctgtcttcgtacaaggttccgtccagacagtgccatccatccggtgtaaccggtttctcacttacaggtttaaaagggccctttggtgaatccgccacgagacactgacatctccgataggttcccctggcccggaaggaggacagcagataatattttcctctccaaatatgtacctcaggagcccaataatcggaatcagcccaaaagtcacctttacggaaagcgatttccggtttggaccaatgtatcaaatccctgctctccaaaacataaaaacagggttcccccgtttctacctcaggaaacctggttcgatccacaaactgcacataggtatagtactttttgctcaccggatccgccaggataaagggatcgctgatatgtacgtccctgatatgataaggataccgtttttccatttcttctttcataagccgtattcaacctccctttttatatacttttaattaataagtgctgctatgtattgtttaattgtttattttgtattattttattaattacaaaagatattttttgtactttttatctatatgtattatcttatatttactgctcccctttcatccactttttagacgaatacctatgcagaattgaccatattaacagaatttacattttatggtatactacatctatgtgcaatatgatgctgttttacagaagggaggagctctatgccaacaaaaaagccaaaaccgatagttgaatacagaaattattaccttccttccagttttcccgtactccttctcagcggggataactggaaaatatccgatgtgagaagtgagcatctccatttccacaattgtctggaagtgggtatctgccacaccgacagcggtaccctggaattctgcagcgcaatgaccatccctttctctgccggcgatgtcacctgtattccccggaatatacctcataccacttactcggcgcgctacaccaaaagcaggtggtcctatttattttttgatccccggctgctcttccgtgatatgcttcctcctgatttcaattacagcatgatatatgatgatatccataaatatctgattccggcaggctcgtcccggcgcattgctcttttggctgaagctgcagtcgaagagctttccgccatgaatccggatcatatgctggtaagaagttatctgtttgttttatatatggaaatcatacgatttcaaaatccaaaaacgcaaaatatgcaacctgaaataccccccccccggaaaaatttccgtacttatccaggaattcactcaatatcaccccggcactcgatttcatcgaggataactacatgaacaaatttcctgtggacctgcttgccgaattatgccatatgagtcccacacatttcaggcggaactttcagtcagccatgcatatggctccattaacttacctgaatacgatacgtatcatgaacgcctgcaatctgctccgcaataccaaccacactatcctcaccatctcagagatgaccggcttcagcaccctgagcaacttcaaccgccattttaaccaaatgatgaaggtatcccctaaagaataccggcatcagactcttaaaggccgaaaaccgggcgaaataccatctattatcgaatatgccggctggctggaacccgatgaggcaccttatcccgggaaacaggaaaaggcaccggaaagaatataataagataacgtgcgccgccaggcgcaccaaaaaaaggcaccctcatggaattccttccatagaggatgccttttctatacagaaaagcaatactgctttcttattttaatcttataccagctccagaacaacttccattgctccgtcaccttttctctgtccgatcttgatgatacgggtatatccacccttacgatccacatacttaggagcgatttcatcaaaaatcttggcaggcatatcaaccttcttggtgcctctcttacgtccggctgcagtggtgggaacctcggtaatcgggtaaagaactttcagcatctgtcttcttgcatgaagtctgctgggcagatccttcttgatttccttctccacttcatcataaacggtaactttctttccgtctacggtttctttcactctcttgccgtctttgtcttttctggcaacctttgcggtaaccttaacggtttcgaaattgtctttttctcttacgcccatagcaatgatgccttcagcgattttacgaacttccttagctcttgcttcggtagtaacgatttttccatgatacagcagattggttacctgatttctcagcagggcctttctctgatcggaagtttttcctaattttctgtactttgccatttttttattctctctttcattcttggtacatccggccacgctcttcggacttacttaccgaatgttttttataagcggacggctgtcagatgacagcctccgcagccaatcatgctacaaagcatctcaaggtacccttgcacccttagtgctattgtgccctgaggcacttttacatctccgcgcacatcggacttatcggaaacgcccatacagattctgtattctttatacgtttacatcatcgctgggattcagctgaagtcccagttcctttaatttagcaagaacctcttccagagacttacggcccaggttacgaaccttcatcatatcttcggaagtcttattggtcaattcttctaccgtattgataccagcacgctttaagcagttataggaacgaacggacagttcaagctcgtcgatgctcatttccaatactttttctttctcatcatcttccttctctaccataacctctgcggtcttggcattttcagaaaggtcaatgaaaaggcttaaatgttcactgagtacttttgcagcaaggctgacagcttcatccggagcaagagtgccgttcgtatatacatccagtgtcagtttatcaaagtcagttacctgaccgacacgggtattagcaacactcatattcactctctctaccggagtatagatggaatcaattgcgatcacgccgataggcaggtcttcgctcttgttcttctccgcgctgacatatccacggcccttggtaatggtcagttccatgtacagcttgctttccttgccgccgcttaaggtagcaattaccaggtcgggattaagaatctcaatatcctgatctgcctgaatatctgaagcacggacaacaccttcgccttcgaattcgatataagcggtcttaggttcattggtttcgctgctgttcttgattgccagactcttgatgttcatgataatttcagtcacatcttccttgacaccgggaatagagctgaattcatgcagcacgccttcaatcttcacctggcttacagccgcacccggaagagaagaaagcataattcttctcagggagttgcccagcgtaataccgtaacctctttccagcggttctacaacgaatttgccgtatttcttgtcctcagagatttcagcaacctcgatattgggtctttcaaaatcaaacactgcaaataccctcctttacgaacgaaaagtttcttaattgaaacgttcacgccagctataagaaattacttggaatacaattcgacgataagcatttcgtctacaggtacgtcaatcatttccctggccggaagttccttaatcgttcctttgaagttttcaatatcaacatccatccactccggaacaagtcttcctgctgtaacttcgaggatatctttatatctctgcattccttttgctttttccttgatttcaatcacgtcgcccgctttaaccaggtaagaaggaatgtttacacactttccgtttaccagtacatgcttgtgatctactacctgtcttgcttctcttctggttcttgcaaagcccattctgaagataacgctgtccagtctgcattcaagaagaatcatcaggttggtaccggtcatccctttcattttatcggctttcttatagtaatttctgaaaggtttctccagcacgccatagatgaatttagctttctgcttttctctaagctgaaggccgtattcacttaccttcttgccggctctcgcattggttctgttagacttcttgtcatatcccaggtacatgggttcaagaccaagagatctgcatctttttaaaacaggtgttctgtttactgccattttagatttcctccaaatattgtttacagtacgtctgtgacgcactttcttccaacgttttcataatttattgttgaacagagactatactctacgacgcttaggcgggcggcatccgttatgaggcacaggagtaacatccttgatgcttgttacttcaataccgcatgcagaaagagcacggattgcagcttcacgtcctgaaccaggaccctttacgaatacgtctacagtcttcaggccatgcggaatcgctgcctttgcagcggtttctgcagccatctgtgctgcgtacggagtagatttccttgaacctctaaagcccagaccgccggcgcttgcccagcttaaagcatttccttcagtatctgtcaatgtaacgattgtgttattgaaagatgactgaatatgtgcctgtccgcgttcaacgttttttctgacacgtttctttgttacttttttcgcaactttcttagccatttaaactaacctactttcctcaataaattatttcttcttatttgcaactgttctcttaggaccttttctggttcttgcgttgttcttggtgttctgtccgcgaaccggaagtccttttctgtgacggatacccctatagcatccgatttcctgtaatctcttgatgttcagagcgatttctcttctcagatcaccttctacagtcattgtttcatcgatgacagcgctcagtctcttgacttcatcgtctgtcagctcccttacacgggtgtcagggttgacatttgcctttgcgcagatttttgttgcgctcggtctaccgataccatagatataagtaagtccgatctccacacgtttttctcttggtaagtcaatacctgcaatacgagccatttacgtttcctccgttttcctttcgcgccacatcccacccggctttccgccaggccgcgcgtttcttcactgcgcattaaatatccggtctttacaataaatatttaacgcgcaattacacaaggcagactccaccctttccacgtctccacgcttcctggtgtatcacaccctgtgcatacgatcaaatcgtattaaataatagttactaattgactggggcgttttctgatgcattccatcaagatcctaaaaaccaatcgattatcactatcgactctctcctagtcctttaaacctcccgaaaagccaacaggaaaaacaaatcaaatcggagatttgctttgtttttcgagcgactgctccgcagtcgcttgcccagccggacatctccatccggcctttccgatactccggtattccgaagaatactgaggatgcctggcaccctaattttcggtatcaaaaagtaatctcccgtaaacccatgtaagaaatcatacagccgctgcagcgctgccgtactccacacgaattgccttacgttcaattatttccaagcatcgttcacacgaacgatactgatgccgcctgaatggaacgacaaggatcagccctgtctctgtttgtgtttcgggttctcgcagataactctgatagcaccctttctcttgattactttgcacttttcgcaaatcggttttactgatgatctaactttcatgttaaacctcctttcaaaaaagaccgtcttaaattataacatgcaaaaacgggttatgcaagcatttccttcggaaaatactcgcatttccttcggaaattcgctattcatccggaaattcgctgttcatccggaaacacctgctttattccgtaaagacaactttttatttatctctccagataatacggcccttgcttaaatcataaggagaaagctccagtgtaaccttatcccccggaaggatacggataaagttctgtctcagctttccgctgatatgagcaagcactctgtgtccattctccaactccacctgaaacatggtgttgggcagcttttccactacggttccttcgatttcaattacatctgctttcgacatactttatttcctttctgtttccaatcatcattgctgcggatttatccgttttttcttaagggttatttctgcgggtataaagatttattttctctctgatctgattattgccccaggcgggattcttcaggaaactaaccaattcttcccgggtgactccgtcattgatcagctgaacatgtttcctgttcttctttttaggatgaagcagatccctgccgcatccgtctgacagatataccatatcctgctcttccttaataatcagataaagcgtattcttgtcatgccctgcttttgagagcgccagttttcctgtcatacatttcctcatttcagcagattgtgaggatttccggttcaccatctgtaatcagaatcgtattttcgtagtgagcagacagggaaccatcctttgttacaacagtccatccgtcgtccatccactccaccggccagtctcctatattgatcatcggctcaacagccaatgtcataccagcctgcagccttacgcccctgcgtttctgtctgaagttcggaatctgcggatcctcatgcaggctggtgccgatgccatgccccaccagatcatggacaattccataaccgaactggctcacgtaatcatcaatggcagcggaaatatcgtacagatgatttccttccctggcctgtttgattccttcaaaaaagctctgccttgtcaccgcaatcagattctttgcatcctcacttatggttcctaccccatgggttcgtgctgcatcagaatgatagcctttataaataagacctgcatccaggctgacaatgtcgccatccttaaggatatggctgtcattgggaatgccgtggaccacctcattatttacagaaacacaaatagatgccggatatccctgataattcagaaagttgggtatgcagccatagccgcgtattaatttttcgcccagcatatcaatgtccagcgtggaaattccggggcggataaaagctcccagttcttcatgaacctccgccaatatcctgccggcttcccgcattaattcaatttctcttgcagatttaatggtcactgccatataaataacctccgaaggccgcaatccttaaccaaggatttttacaattgcatcaaaaacctctgtcataggaagggttccgtcaactgttctcagcacgcctttggctttataatattcaatcagaggctgtgtctgttcatgataaaccttcaaacggtttgtaaccgtctcaggctgatcgtcttctctgcataccaggtcgctgccgcatacatcacagataccttcttttttaggcggtatgctgacaatgtggtaggtcgcgccgcaattcaggcaggcacgccttcctgacattctgttgatgatattttcatccggcacatccacatctaccgcgtaatcaacgctgtcccccagcttggtcagttcgctgtcaagcacttctgcctgaggaatcgttctcgggaaaccatccaggacataaccattgctgcagtcatcctgtgcaactctgtccagaaggagacggactgtaagctcatcgggtaccagaagccctttgtccatatatccctttgcttcttttccaagctccgtaccatttttgatattagccctgaaaatatctccggtggagatatggggaaccccatatttgtcagctatcattttggcctgggttcctttaccggcgccaggagcgcctaacataataattttcatagcattttctccgttttgaggacgcaatgcgcactcagttctgtattgtaccatttaccatatcgcattttgggacaaaacaaatgttctgtcccaattatcgtaagtttataatattaatcgttcaaaaagcctttgtaattccggacaagcatcagggactctatctgtttcagagtttccagaactacgctgacaacgataataaggcttgttccgccgaaggaaacgttcgccccgaagataccgttgaatacaaaaggcagtacgcagacaatagtaaggccgcatgcgccgatgaaaataatgtagttcaggattctgttcagataatcactggtaggcttaccaggtctgataccggggataaaaccgccctgctttttcatattgttcgcaatctcaaggggattgaaggtaatcgatgtatagaaataagcaaaaaagattaccagggcaatataaacaacaagaccgatagaataaatcggctcactcggtttgcaccagctgtttgaacttaatcccttaaggatgtggctccatacccctgttcccttgtagccgatgagctggcagataatgacggggaactgcatgatggatgatgcgaaaataacagggataacgcctgcggtattcaccttcagcggaatgttggaagactgtccgccaaccattttccttccctgtacctttttagcatactgtaccggaatttttctggtagcatcattcaggataataaccagaataaccatggccacgattaccgccaggatgatgagcgccgccagtacagcggttgccaccggcttaccctttacaaactggttgtaaagccctgccagatcctgaggcattctggaaacaatattaatagtcagaacgattgatataccattacccacaccattctcggtaattctttcaccaatccacatcaggaaagcacttcccgcggtgagagctgcaactaccgtaataacattcaaagcattgaagctttccagcagtccgcttcttccgaatccgatcgccatggcagtggactcaatcagagccagacctacggttacatatctggtgatcgcggtcagctttttacggccgtcctctccgtccttctgcatttcctcaagcttcggaatggcaatagtcaagagctgtataatgatggaggatgtaatatacggtgtaatgttcagtgcgaacaatgacatgttcaggaaagaacctccggtaaatgcatcaaagaaattaaatgcatcgccggtctgcgccgcaaaccatctggaaaaataagttctgtctaccccgggcacaggcagctgtgatcctaaacggatcacaaccagcatggcaaaggtataaaagatctttttcctcagctctttcattttaaatgcatttttaagggttgtaagcattacatcacctctgctgttccaccaagtgcctcgattttttctttagcggatgcgctgaaagcatttgccttaacatcgagttttttggtcaattctccatttccgaggatttttactccatctttaggatttttaacgattccctgttccagtaatgtttcaacagtaactgtggttccgtcttcaaaaacttccagagcattcaagttaattcctacaatttccttagagtttctgtttgtaaagcctctcttaggaatacgtctgtataaaggcatctgaccgccttcaaagcccggtcttgttgcccctgaacgagccttctgacctttatgtcccttaccagcggttttgccgtttcctgaaccatgtccacggcctcttctgaagttatcgctgtgcttggaaccttctgcaggctgtaagtttgataattccattcctgacacctcctgttcttatgcttcttctactttgagcatgtaaccgacatgacgaatcatacctcttacggattcattgtcgggcagctcaactgttttgtgcattttggtaagccccatagcctttacggtagccctgtgcttgggaaccgcaccaataggagattttaccaatgtaatttttaacattttttctgccattttaagtttcctccttaagccatgatttcgtcaacagatttaccacggttagctgctacttcttcaggagtctttaactggcttaagccttcgatggtagcaagtacgacattctgcttgttgttggaaccaagagatttcgtacggatatttttaatacctgcaagttcgcatacattacgaacggggccgccggcgataacaccggtaccatcaggagctttcttaagaagaacggttgcagaaccgaacttgccaaggaagtcatgggtaatactgttgttttcgtccagtgcaactttaataaggttcttagcagcgtcttcttttcctttacggatagcttccggaatttcagttgcttttccaaggcctacacctacatggcctgcgccgtcacctactacgactaaagctgtgaaacggaagttacgaccaccctttacaaccttagttacacgcttgatggaaaccactttttcggtgagttccaaattgtttgtgtcaatgattgtatgtctcatttacgatgtgttctcccttcctagaattccaggccagcttctctggccgcatcagctaacgctgcaattttaccctgatatatgaagccgcctctgtcatagacaacggtggtgattcctttttccagagccctcttagcaataacagttcccagatatgctgctgcatcaacgttattggttttttccagttcagcttttatgtctttttcaagagtagaagcagaaaccagggtatttccaactgtatcgtcgataatttgagcatacatatgattattacttctgaacacagcaagacgcggtctttcagcagtgccgctaaaacggttacgctgttttctgtgcttgttcaaacgaacttcttgtcttgacttcttactaaccatttttacactctccttatctatttcttaccagtcttaccaactttacgtctgattgtttcatcagcatacttgatgcccttgcccttataaggctccggtcttctcttgtctctgatttcagctgcgaattggccaactttttctttatcgatacctttaacgatgatgatgttctgaccttcaagcactgtttccaggccttcgggatcttccatctccaccgggtgggaataacctaaagataaggttaatttatttccggactttgctgctctgtaaccaacaccatttacctcaagcttcttttcgtagccctgggtaacaccaacaaccatgttgttgatcagtgttcttgtcagaccatgcagggatttcatcttcttcaaatcattaggtctggaaaccacgatttcgtttccttccatcttgatttccatttctgcagggagcactctttcaagtgtgcccttaggaccttttacagtcactttattattttctgcaatttccacagtaacgcctgcgggaaccgcgattggcattcttcctatacgtgacatgcccgtacctcctataatttatttaaccaaactgcccgttaacaagctgctttcagtctgcgtacagcgatttgtatcttaccagacaaatgccagtacttcgccgcctacctgaagctctcttgccttcttatctgtgataacgccctggttgctagagatgatggcaatgccaagaccacccagtaccttgggaagttcttccttgcctgcgtatacacgaagaccaggtttggaaattctctttaagcctgtgatgatcttgtgattcttgtcttctccatatttcaaagtgatatggatggtcttgaaagcaccgtcatccagaatgtcatatttcttaatatatccctcgtccagcagaatctgcgcgatagccagtttcattttggatgaaggtacatctacggtatcatgttttgcagtatttgcgttacggattctcgtaagcatatctgcaatcggatcgctcattgtcatttgaattgcctccttcttaccaacttgctttctttacgccggggatctgtcctttatatgccagttcacggaaacagattctgcagattccgtattttctcaacactgaatgtggacgaccacagattttgcaacgggtatattctcttgtggagaatttaggtttacgctgctgtttaatcttcattgctgtcttagccatgaataacctccttatttctcaaaaggcatgttgaataatctcagtaattcacgtgcctcttcgtcagtctttgcagtagtaacgataataacgtccatacctcttactttgtcaaccttatcgtattcgatttcggggaaaataagctgttctttaatgcccagcgcataatttcctctgccgtcgaatgcatcaggattaacacccctgaagtcacgtacacggggaagagccaggtttacaagacgatccaggaaatcatacatcttttcgccgcgaagggtcgttttacatccgattgccataccttctctgattttgaagttagcgatggaattcttcgctcttgtaagtactacatgctggcctgtgattgtttcaaggtccttcacagcggattccagagcctttgcattgtccttcgcttcaccaacacccatgttgatgacgattttatccagcttcggaacttccattacatttttatatccgaacttcttgctcattgcttctacaatctgttcgttgtataagtctttaagtctactcacgtttacggcctccttccttagaattaatcaattacgtcgccggttgatttagcaaaacgtactttcttgtcattttccactttgaaaccgattcttgtcggttttcccttgtagacatacattacgttggacatatcaagcgcagcttctttttgaataattccgccgttctggttagctgcagacggtttcgcatgcttggtaaccatgttcacgccttcaacaaccactttgccgttcttcttatctacggaaaggactttgccttctttgtccttatccttaccggcgattactttaacggtatcgccttttttaattttcattgttgacatagggcacctcctataatacttcgggagccagagatacaattttcataaactgtttctcacgaagctctcttgctaccggcccaaagatacgggttcctttgggagtcttgtcatctttgatgattacagcagcattttcgtcaaatttgatataagaaccgtctttacgacgagcgccttttaccgtacgtacaacaacagcttttacaacgtcacctttttttacaacgccgcctggtgttgcatctttgacggtggcaacgataacatcgccgatactcgcataccttcttgtggagccacccataactctgatgcacaggagctctttcgcaccggtattatcagcaactttcaatctgctttcctgttgaatcatgctaattctccttccgccagattcacccccgcttgaatgggatcagaacctgtattccaaattattgcaaacgttaaaaataacgctaattattttgctctttcgataatttccacaagtctccatcttttatctttggagagcggtcttgtttccataactttaacggtatcgccgatattgcaatcgttgttctcgtcatgagctttcagcttgtaggttctcttaacgatcttgccataaagaggatgtcttacatgatcttctacggcaacaacgatagttttctgcattttattactaacgactttaccagtacgtgtttttctcagatttctttcttccacgtcgatgtgctcctttctggaatgttaacggcttactgagcagccttggctttttcagtaatgagggtctggattcttgcgatattcttcctaacctctttaattcttgccgtgttatcaagctgatttgttgcgttctggaatctcaaattgaaaagttcttttttagcatttaccagttcctgtgctaaatcagcgtcggattttttctttaaatcttcaacatactgtttagttttcatttgatacaccgccttccaaatctgccttagaaacaattttacatttacaaggaagcttatgcatagcgagacgtaatgcttcttttgcggattcctcaggaactcctgcaatttcaaacattacacgtccgggcttaacaactgctacccagtattccagagtacctttaccggaacccatacgtgtttctgctggttttgctgttactggtttgtcagggaaaatcttaatccatactttaccggtacgttttgtataacgtgtcagcgcgatacgggctgcttcaatctggttggacttaatccagcacggttctgttgctaccaggccgtactcaccgtaagtgatggtgttgccgcgcattgccttgcctgccatagaaccgcggaactgtttacgacgtttaactcttttaggcattaacattatttatcgctcccttccttgtttcctttcgcaggaagtatttcgcccttgtatatccatactttgacaccgactttaccgtatgtggtgtttgcttctgcaaatccataatcgatatcagctctcagtgtctgaagcggaatggttccttcactatagaattcggtacgagccatatctgcaccgccgagacggcctgcacatgctgctttgatacccattgctcctgctttcatggttctgcccatgcaggatttcatagctcttctgaaagatacacggttttccagctgtcctgcaatgttctctgcaaccagctgtgcatccttgtcaggtctcttgatttctttgatgtcaacaagaaccttcttgtctgtcagcttggacagctcttttttggttacttcgatttccgcaccgcctttaccgataactacgcccggcttagctgtgtagataataacctttactctgtcggatgctctttcgatttcaatcttggaaacaccggcactgtaaagttttttctttaaatattttctgatgttgtaatcttctactaaaaagtctgaaaactcagcgtctgcataccatctggaatcccaatctttaatgacgccgactcttaagccatgaggattaactttctgtcccatattttctcctttcacaatgtcccgttcgggacacttccttcctcggattatttctcatccagcaccaaagtaatgtggctcattctcttttcgatacgataagcccttccctgtgccctggggtgtactctcttcattgtaggtcccttatttgcgtagcactcagcaacatacaggttatctttgttcataccgttgttgttttcagcattcgcaactgcagattcgagtaacttcttaatcaggctggatgcatatctgggattgtattccaggatagccagtgctgtcgttacgtctttgcctctgatggcatccagtacgaagcatgctttctgtacagaaacccttgcgtatgataactttgcagaaggtcttgtatctttatttgcatttctttctctctttatttgagttctgtgtcctcttgccatggataaaacctcctttcaattatctcagcttggatttcttttcgtcttttccatgtcctctataggttctggtggcaacaaactcaccgagcttgtgtccaaccatatcttctgttacatatacaggcacatgttttcttccgtcatggacagcgattgtgtgtccaacaaaggacgggaagattgtagaacggcgggaccaggtcttaataacctgtttctgtccggcagcgttcattgcatctacttttttgaggatgcttgcatcagcaaacggtccttttttcagtgatctagccattgattctttcctccttatttaatagccttaccgtctcttcttcttacaatcagcttgttggacttgtttttcttcttacgtgtcttcaagccaagtgcaggtttgccccaaggagtactcgggcccggacgaccaataccggtcttaccttcaccaccaccatgaggatggtcattggggttcatgacggaaccgcggacagtaggacggattcccatgtggcgcttacgtcctgctttaccaatattgataaggttgtggtcgccgttgccaacaacaccaacggttgcgcggcagataacgggtaccattctcatttcaccggagggaagtctcagtgttgcatattttccttctttagccatcagctgtgcgccgttgccagcggaacgaaccagctgaccgcccttgccgggatataattcaatgttgtgtacctgggtaccaacaggaatctcagataaaggaaggcaattgccgattcttacttctgcgtgagggccgttcatgattttcatgccatccttcagtccttccggagcaaggatgtaagccttctcgccgtctgcatagcagatcagtgcgatgtttgcggttctgttgggatcgtactcgattccgattacagttgccggaacatcatctttatatctcttgaaatcgataactctgtattttcttctgtttccgccgccgcgatgtctgacggtgattttaccctgattgttacggccggcattcttcttcagagatacacaaaggctcttttccggagttgactttgtaatctcagaaaaatcggagccagtcatatttcttctggaaggtgtatatgggttatatgtcttaattcccatgattttatctccttttcttcatcatttattgtcgtgcttgatttgcacttagcaggagcagtccggagggtttaaaccgtaccgtgtgtctcctgatgcaagtacatacgtacccgcattcgcgtttcttacagaccggcgaagatttcgatatctttgctttcctctgtcagctgaacaatcgctttcttggtctttgcagtcttacctacaaccattccgcgtcttctgttcttgccttcacagttctgtgtatttacgctcttaaccttggttccctcgaacattttttccacagcttctttgatctgggatttgtttgcttcaggatgaacaaggaaagtatatttcttttctcccataccagccatgctcttctcagtgatgacgggtttgaggatgacatcataatattttacgtcagccattatgcgtacacctcctcgatagtcttaacagcatccttggtaagaactacggtgccggccttcattacatcatatacattcagagtgcttgtcagagttgtattgacggtgggcatgttctttgcgctcattaccacgttcttgtcattttcattgattactacaaggcctttgctcactttcaggttatccataacctgcttgaagttcttagtcttgatttcgtcaaatttcaattcatccacaacgatgagcttgttttcctgtactctgcttgttaatgcagatttaagagcagctctcttttccttcttgttaagcttgaaggaataatctctcggaacgggagcgaataccacaccgccgccggtccactgaggagatctggttgaaccctgtcttgcatgaccggttcctttctgtctccaaggttttctgccgcctccggaaacttcagaacgtgtctttgccttctgtgttccctgacgcttgttggcaagctgccaaacgactgccatgtgtaccaggtgttcattcacttcaacgccgaatactgcatcgcttaagtcgagcgttccgacttccttgccttccatattaaaaacagctacgttagccattgttagttcctcctttcacccctaatttaagcatccattctcgtggtttctttgatagttaccagtgctttcttagggcccggtactgcgccttttaccaaaagcagattctgttctgcatcaacccttacaacttccaggttctgaacggtaacctttacgcagcccatatgtccaggcattccttttcccttgaatacacggctcggtgaggagcatgcaccattggaaccctgatgacggtggaatttggaaccatgagccataggtcctctgtgctggccatgtctcttgatagcgccctggaatcctttacctttggaaatagcggttgcatccactttatctccggcagcaaaaatatctgctttgatttcctgagccggtgcatattcggatgcattgtcaaatttgaattcccttacatatctcttgcaggaaactccggctttatcgaagtggcccttctgagccttcttaacaccatgtctgtgaataacttctttcttaccgcccttgtctttgttgactgttctttctttcttgtctacatatccaacctgtacggcgctgtagccatcgttgtcaacagtcttgatctgggttactacacaggggccggcctgaagtacggttaccggaatcagggaaccatcttcattgaaaatctgagtcattccgactttggtagctaaaatcgctttgttcatgaattttacctccttgttttctacatagcggaatagtcacggcgttgccgcgccgaagcatcctgtcctgcaggctgcctgaaaaaacgtctgtgccgttctttctccgaacaccattcatacgtctttgtagaggtttgctgtgttgattatttggttttcattttgatgtcgatgtaaacaccggcaggcatttccagtctctgcagagcatctaccgttttgttggtaggagcaatgatatcaatcagtctcttgtgggttctctgctcgaactgttctctggagtctttgtatttgtgtacggccctcagaatcgtaactacttccttcttagtaggaagaggtaccggtccgctcacctgtgctccgttcttcttaactgtttcgatgattttcttggcagacgcatcaacaagctgatggtcataagctttcaatgtaattctcattacctgatttgccataaaaaaagtcgcctccttttcgcactttttgttgaagtacgacaagcggtgactgtacactctcccgtgtgtgtcctaaattttgacgtatcaatacgtctgcgactgttggaacctcatcccgttccttcaggacttttcacgcggttgtttctgtttaataacagacttcattgcttgtacagtgacttgtcgtcagtttcctaacttgacattcgctccacggaaaacccgccctttcaggcagcaacctcacgcttcatcgctatcatgtcacagcatttgttattatactggtattttcctgaagttgcaagctttttttcttaaaaaataaaatttttttaatttttttttataaatctcttttttctgttaaaaagcccggattccgggacaaaaccgtcctttcctccgggtctttttttctgtttcttcctattataatagaacgtattacatattcttttccctctggttgttttttatgatcaggagtacgccgacaagcagagccagtcccaccggcagggttatccagacgctcttcacaaaaccggccagcagataggtcacaaaggataccgctgccaccgttatcacataaggaagctgggtcgtgacatggttaacatgatcacactgcgccccggccgaagccatgatcgtggtatctgatatgggcgaacagtgatcgccgcatacagcccctgccatacaggctgcaatggaaataatcataagctgaggatccgatttttcaaatacggcaaccacgatagggatcaggataccgaaggttccccagctggtacctgttgcaaaggccaggaagcagcctaccaggaaaataatggccggaagcaggttcatcagcccgcctgccgcctgttccacagcccctgcgacgaattcagccgctccgaggctgtccgtcatggccttcagcgtccaggcaaaggtaagaatcagaatcgcaggaaccatggctttaaagccattgggaagacaggccatacagtctgtaaagcccagcactctgcgcacactgtaaaaaataatcgtgataaccatggcaaaaaagcttcccagggccaggccgaccgaggcgtcgctgttggaaaaggcggtgacaaaatccgcgcccgagaaaaaccctcccgtataaatcatgccgacaatacagcagataatcaaaacaaggatgggcaccaccaaatccatgacctttccgttgggattggcggtttccacctccacctctttttcttcctttttccctgtggaaaaaaggtcgcccttcatggcattcttttcatgggctgccatggggccgtaatcaaacttcatgaccacaagaatgatcatcatggcaatggtaaacagggcataaaaattataagggatcgcacggataaatatggaaaatccgtcctcgccttccacgaagcctgtcactgcagcagcccaggacgaaatcggcgctataatgcaaacgggcgcagccgttgcgtcaatcagataagccagctttgccctggacacattatgcctgtccgtcacgggacgcatgacgcttcccacagtaaggcagttaaaataatcatcaataaatatcaatactcccagcacaatagtggacagctgggctcccgcacggcttttgattttttccttcgcccaccgtccgaaggccgcagagccgccggcgcggttcatcaggctcaccatggctcccaatatgacaaggaatatcaggattcccacgttataaccgtcggacagcaccgcgataaagccattttcaaaaatatgggtgacagtgccttcaaactgaaagccggaataaaacagtcctcccaccaggatccccacaaacagggaactgtacacttccttcgtaataagcgccagcacaattgccacaaccggcggtaccagtgatgcgaacgtggcatacattgcgggtgccggagcatctccgtccgccgccagaaccgtcatggacgccatggccgccagcataagcataagcaccaggcccctgcctattttctttcccgtttccttcatacaactaactcctctctttcccctctgtttaagatgtgtgaccaacacgcaaaaaaagaccgtgaatgcggcgctaacaaaacacattcacagtctctgattccttacaagcattttatccaagatagcgctccacatccttgtgacagtgcaccgcatattctgctgtgccccagaaaaaattccccggaccgggaaccccttcttcggcggcctttcctttccctggcggacggctgtcctgttccatagcccgcctggtactgataaagcccgcacctctatcattctctattcttttttctgtatgtatactggcattctatcatcccgtaccgaaaaaaacaagtgtaaaagttgcattcctgcagcggttcgtgtatagtatatgggaatatacggataccggcgtttttttctctgaaagatgtgcggtatactggaaatagatgaaccgatgatacaagggagaatggagcagccatatgtggaaagcggataattggaaagattacgaagtactggataccggaaacggagaaaagctggagcgctggggagaatatctcctggtgcggccggatccccaggttatatgggacaccccccgcaaggcacccggctggaagaaaaaaaacggccattaccaccgcagcagtaagggcggaggggaatgggagttttttaacctcccggaagaatggagcatccattacggggaactcactttccgcctcaagcccttcagcttcaagcatacagggctgtttcccgaacaggcggtaaactgggactggttctccggcattatccgcagttcgaagcgtcctctgaaggtgctcaatcttttcgcctataccggcggcgccactctaagcgctgccaaagccggagcaaacgtcactcatgtggacgcatccaagggaatggtttcctgggcaaaagaaaacgcagcggcatccggtctttccgacgcaccgatccgctggctggtagatgattgtgtgaagtttgtggagagggaaatccgccgcggcaatacctatgacggcatcattatggatcctccctcttacgggagagggcccaaaggtgaaatctggaaaatcgaagaaagcatcttccctttcgtaaaactgtgcagccagctgctttccaaagatgctcgctttttcctgatcaactcctacactacgggactgcagcccgccgtgctttcctatatgatgcagctgaccattacccccatcctgggaggccgtgtggaagcggacgaaataggactgcctgttgcggaaaacggccttattcttccctgcggcgcctcaggacggtggagcagcgggaacatttaacctaatcccgatattactcctgctaaaactaccatatagaatataaatgccagaaccagaagaatggccgaccagatcagcgcagccttacagaaattagctctgctctgattttccgtaccgccaaagccccatacgaacagcatgacaagtcccacacagggaatggacagcacaagcagtgtcactatccagtcggatattttcatgggttcctccggtcctgcgggctgtatgggattcccctgataagggctttccggataatagccctgatagcccggctggccgttcatctgctgatagctgttcccattgggaaaagggttcctgttccggccgggattctgataagtatttgaattctgataggtattcggattctgataggtattcggattctgatacatattggggttctgacaggtatccgtatttccataggtatttccctgataatacgggccgttatagggagcctgcccgccaggggaagaattgccctgcccataagccgcggtattccggtactggctgtttcccgccggatatccctgagccgtattgctgttagcgtttccctgattctggtttccttcaggcaaaaccgcatcctgatattcctgattaggggtgctgtctccctgccggatatccgatgtattctgaggcgcttcggctcctgccgcttctgcttctgccttctgctctccgtccttatccgcagcagacagatcttccgccataccttccgcctctttattctgctgtgtctcttctgtcgttccaaaccaatctctgtcgctcattcaaacctcctgttatcgcatccggctcttcttatgactcttttccacttgtaactgttccgtatcttcacagttattttattttatcatattccgaacagatgccgcaataaatcattataaaagggaagcagccggttcaggatattatcccttttaaatgacatgggaggataccccggaaataccgtcgccatgcggtaaagatataccgcaaacatagccgcggctatcaccgcaagccattttgtcatacctctgactgattttcccattatataacgccggcagcaaaaccagaccccaaaaatcacccacagatatgcacagggattcagattccaggctcttacaaactgtcctgtaaaaatacaaatcacagccctggtcgtaccgcagccaggacatggaaaccctgtcagaataagcagggggcagaatgcatgaaaaaccgacctcaccacaaaataatagatcagaaatgccgctgccgcccatttatactgtttcacatcgcccgctatccggcgcagaatcagctgcatacaatctccttaataaaaaaatcccttccgctcacaagcttcatattccggctgccgcagtcaggacagattccgccgcataccgttgcatgaaattccttcccgcagtccagacagaggccgtttgccggcagaatctctatttcaagctccgcattctccagcatggtttcttcaactgccgcaggatatacctttttcatatattccggtataacggacgaaatttcacctatctgcagaaccagagtttctatcttatccacctgattctccacggcaaacttttccaccgttttcactatttccattaaaattcccagttcatgcaaggcggcttactccttccattcccgtacctgctgtctgagccagtcagcccattcttccatcccctcccctgttcttgcacagacagggatgattttaatatccgggtttatttttctggctctttccatacaggcttccatatcaaactcaaagtaaggaaggacatctgtcttattaatcaaaaggacatccgaaacagaaaacattaacggatacttcaggggcttatcgtctccctccggaacactgagaatcatggcattcctggatgagccggtatcgaattccgcggggcataccagatttcccacattttccagaatcgccaggtcaatcccctctgtttccagagcctccagcccctgtttcgtcattcctgcgtccagatgacacataccgcccgtatgaagctggattacctttacccctgtctctgaaatagcagcggcatccacatccgaatcaatatccgcttccataacgccgattttcatttcatcctttaataacgcaatggtctttttcagagtggtcgtctttcccgatccgggggaagacatcagattcagcagaaaggttttctgcgcctttaattccctgcgcagttcatccgcttccctgtcattatcttcaaatatgcttttctttatttccaatatcttatactctttcatatccttctcctttgctcagaaatttagtgattctcttataaaggtaacactctgtccgcgcaaagtcaacggacactgaaaagccgtctgaaaaaagcacctcgttacttttcccgggttccctctgccgccttgcggttcctctgtccggcttccctcctccggccttgctgttctgccttccggctggcaaggttccttatagggcaaacgacttttagtcgttttgctttcgctcggataactacgcagcggtactaaggttgcaaagaacgcaacctaaggaccggcgtagttatacggcccttacaggaatccttgccagccggaaggcagaacagcaaggccggaggagggaagccggacagaggaaccgcaaggcggcagagggaacccgggaaaagtaacagcgccgcccggaggcagcgctgattcagactgttttattcatattccacgaattcggaatattccttccagatattgcagagccaggtttttccctgattgaaaataatttcatttccgtcctcatcatagaatttgggagggactccgtcgccgtccatacgggaccaggtgccttttatgacttttccattggtaaaaacaagggcgtcgccttccccatggacaccgaatgccagataatccttggcatccctcacttctccgtggcagtactggaataccacattggatacggtgagctgtttgttattcatctcatcaatctgtttctttccgtcctggaagcgataatacagattgtcctctttattatattcaaaataaggattataggcgccatatccgcctgcattgctcttggttccgcccggacggatcgttacggcatcctccgcatcctcatattcggcccgatagccttccgcagcaaaagtaaactgggggacataatcatcatcatattcccattcatatcccagacggtccacggcgtccttcaaaccgtcaataaacagatatccggtaaactctttggcataaccgggacggctaatccgtccgtaggcttcgtccgcaggcttatggattccatccacacctacgctgatattctgtaccgtatcacggttgatcaattcctccacataaggcttggccagtccccagttacaataaatggcctgataccccatcgccgtataaacataataatccctgctgctccttatcggcccgatatggtctaaatcgtcgaaatcctcaaaaatagccatcagacgggtaattcttccttccacaggagcttcgtaaataatgctcgcttcagaaatgccgtattgaggcatagcctgggcattattaggtatcatcactgccagcggccttctgaccactacttccttatccttccattcaccggtaagataactctgcatccggccgtcaaccactttacgctcttcaattatctgaaggcccgcttcttcggtttccgtttccgattccgtctctgtttcgctttcctgcacctcggagggagctgccgttgtctcctcgaccatagtttcctgctttttgccgcaggcagtcaatgctaacgccatagccattatggaggccacggcaaatattgtttttttacgtttcatcatttgtttttccttttttaaacaaaaaaacctgatttacagtaactgaagttattatataataaccagttcccttttgtccatgtaaaagaaaggaattctttcctgccgcaacaaattcacccgaaataacaatatttgtctgctccgtcttctttatttcacctgcgcctttctgtaaatcctgtataaaagaggacatatcataacagtcattacagaatacaccaccagaatgatccccgccgcccctattattcttcctgcaatactgtaaaggttgaaataagaaaccaccatattcatctgcagcagctgatccggcataagccccaggattttatttataagagggaacctgattccgcctaaaaaagagggaacaaaaatcaggataaacggcatcattacagcaaccacagcggatctggatgccgcggatatcagcatggtcagaaaaaggataaacaaacagcccgcataaccccccgcaaaaaccagcagtccctcctgccaataggttatattatagaaactcttccagcctccccttcctgtctgtatcacacagttcgctccgtcagcccccagtattccaagcacaatccccacatagagaagaacagacagccagtatattcctgttatcagcagaaagcccgcctttattttggcagacaccgcccttcctcttccatgacaggaggcaaaaaaaacagagtcggccttatactggtattcacacgaaaagagactggctgcaaggaatcccagtatcaaaaccattatcatcagcagagtcggagcgaactcaaacagctgcttccatccatccgcataatcataatatagaggtgtctccatctcctgatatttttccaccagaaaagctttttcttcctctgaaaactgatcttttgcctctgtgtccagccattccttcaggtgagctgtcctgttggcataaaaggcttccgcatcttccggcacaagggaatccggccgataataatcataatccctgaatgccccataggcataaaccagaagcatacggatatcggagaagccctgtttccagccaaaggcaatatctgacttacgggtattcctggaacggtactcctccgtattatttaccgcaagattggcggcgatcacctccccaatcttttcttccgtaagaggtcccgaccattccttctttacctccctcagctttctgaccgcagcgacgccgttctctttttctccctgttcattcatataactcactccggaaacggcaaaaccacagacgacgatcaaaaggccgataagacacattacggcgatcctgccgcttgttttggaaaaaatctttttcatctcataataaaccatcttcgtcaccgcccttttccccgaaataatataagaaaacatcctccagcgttatttcctcctgcttcgcatcggggcagggcctctcttcgcataaaatacgaagctccacacctccggaggttgttttcatattggctaccttatattccttcgcccaatcctgcgccttgcttctggggacggtacagctccagaccctgtccggcacggaggacatgattttttccggagttccggagcggacaatatgtccgtcacccatcagcatgatttcattggcgatatactccacatcagacacaatatgagtggacagcagaaccagcctgtcctgtgaaagcccgctgagcaaattgcggaaccggattctttcattgggatccagacctgccgtaggttcatccagaatcaatatttccggatcattcagcatggcctgtgcaatccccacccttcgcttcatgcctccggacagcttcttcatcttcttatggaccacttttgccagacctacccgcggcagcagttccatcactctcttttttgccgcagcctgacgcagccccttaatagaagcaatatacatcaggtaatcctgtaccgtaaaatccggataaaacccgaactcctgaggcagataccccagccgcttcctgtattctccatccatttcaaaaatatcctgcccgtcacaggttattttcccctctgtcggcttcagcagggtacacagcattctcattaacgtggttttaccggctccattcactcccaaaagcccatagacaccattcctcattcggcagctgacctgatccactgccgtaaaaccatgaaattcctttgttatcccatccagttttaactccatgatatatttccctcctgatcattcctgcagcttctgagaaagcaaaaaatcatacacgccatataagaaacggaaacgagcagcattaaccaccacaccggccttgctacagcgttataaacggcttcgttcagcactatcaatatccagaccgcgatccacagaagggacagcgccacggccatgtattctgagccataccttctgcagcataatacggaaaaacagatacagcaggttacattaaacggcaggaaaaactgaatcagcaaatcctccgctgtcagctgtaccgtggccgataccgctccgcaaaacaggctcagcaaaaagaaatccgccattccaaaaagaagcatccttgccgaataaacctgccgcagggaataaaaggcagctccctccacttcttcagaaccggagctgcggtttttccagaattcaggtatcagcagaatcacgaaaacaggtgcaaatactcccatgctcctttccgcataataattaccctccgccgaatacatgatccaccacaaaagaatgagtgtaaggaattgtaaaaaccaccatctttttcttatgtatgctccctgctgaatcaggaactccatataggatgcagtctgcttctgttcgttccggtaaaaagtgttttttgacagccggattgtctgctccagtctgtctttatccggcccgatatccgtttccttcttatatgctttcagcaatgcttccagtctcttcttttccgccatcattccctctcctttcccaaaagctggcccagctgttcttttgcctgtttcagcctgtactttacaagaggcaggcctatacccaaaatatctgcaatctcccgctgcttccgttcctgaaaatagtacagaataagtatttcccgaagctctcccggcagcctgcggagagcttcctccatatccagcctgcagtctacaaaatccatggtgtttccacaggcatccggtatgtccgggacaggcaggcttgtactcttcttatagaaatccctgcacagattagcggcaatcgtataaaggtaattcagcgcttttccatgatgccggtaaacggacaatgctccaaaaaatttcacaaatgtttcctgcgtgatatcctccgcataccccttgtccgatacatggtaatggcagtaacagagtattttcggataataacggcatacaaaactttccatagcggattcgtcaccgttcttcattttatttatcagaagaaagtctttgtccatgaggaattcctttcgatagattaaagaggcctgtacggaacgctttcctctttctatgtataacgaatgaggaaaggaaaaagatagttcttttctaagatttaatcaaaaatggggaaggcggaaaatgcccatattccttcctgcaaagaaatatgggcatcttaatatttgctctttgagttattttgctttttctttaccagccagccccagggaaatatagttaatcgtattttcctgtctcctgtaaaagccttactttccttttttcttcttttacattcagtaagatatctgcaaatttctccgcttcttccaaaataagctttccattgcctgccattcttataatcatatatttagacgctcctatcgcaatggggattttataccatttcccttttatctgcatgacaatatttattcgggatgcatacgccctgtccttcttatgacccaattcataatcaacagaaacacttacagagtcaatatccgctatcggaatatactggatcttaaagggattagagataaaaagcacggcaagctccccatttatcccatccagccaaaaggtacacgtttttgtatcataggtatagctgcagacaaagaaatccttctgctttttattcctgacagcagaataaattatctgcagaacgagcatgaggcagaaaaaatagcagagataagcgatcgccagcggaacaatcatatatagattatcctgtgtcacaaatctgcttttcagtacaacagcaggaggtattaacagtaatataacgtaataaaaataattcttttgctgcatggctattccccgctaaagcaatttattctttatatttccctgtatttattctaacataaaagaaaccgcaattctctgatttctcaaagaattgcggtacttatttaaaagaatttgctctgtatcaatgattactcgatgatagtagcaacacggcctgatcctactgtacgtccgccttcacgttatttgaataccgtatttcttcgtattttctatgctttttggtggcaaatttcgcagaaaactgctgtttttgcattctgtatttcaatttgttcgatttcttggcaccgttttggcaccgcatagaaattatttatttaagttaactataacatcccaagtacacataaacaacttgtcttctaatggcatctatgaacgattgttggtttcataatattataattctcattattcattctatctgtttcagttaaaattaatcacatacaaaggaacaacaacaacagtgacacaaaagagtaaagttcctattttgtatattacatttcttttccaaaaaaggtagtacattatgaattgcaacaccgtacacgttgtaaaataaattatccattttagctcccactgaacaatttctattatttgctgaaagttaaattcagtaaagactacacttacaataagtatccaaacaaatggtattaacataataaattcgtacatcactaatgccaatactccttcttttacactaaatttccgtataaaaaatgtaactcccattgaaagtatacataataaaaatgttctataataatctgagaaaattatttctactatcatattcccatctccatgaacagtaagttatttacaaattcaatttgtcttttattatcaattatatactattgccatccacccttatcttcattctgatacacagtaagtacaccataatactttgctaccacgcctccatcctgcgtatacttccctacatcttcgattccatatctcaaaaggaagtaatccatatcatgcagaattttatatatatcatttgcatattccatttcgtgagtttcggttgccaaattagtcaaatctatcaatctctgaaggtctgcgtacagttcctcattatgaattgacttctgcatatcttgaatcaagtttacaaaatttgctccgtcaaatctattataaaccattacgggtttaccatacttttgataaaattcactttccgtaataccttcttcattcatgactgttattttattactgtcatacgcccacccaacttgaatatcacctttctggtcgaaataattccaagcaagactgtctttatcttctagtttatcaaagatgccatcattcagatatgctcgttccatttgaagatttgcaactttaatattctctgttaatctttccttctcatcgtcagtcattccgtccaatactttttctctcatagcaaaaacttcttctttcgtaggtgctactggttctatttggacattattttcctctgtttcttcttcaataattagactgctttctgtttccgtactctcctctattactgaatttcttatttcttcattttgttctgaacatccaaccaaaaacatcatacacagtataaacaaaacacatctctttttcataaattactcctctcgcttttaataggtatccattgatgccaatatctcaagattagctttttcgtactcgtttaacacactatcatcaaaatcttctgctttacaagttggattataccacacacaacccataaaataattatacaaatcttcattcttaaaaatataaccatgccttgcatatatttcattttttgccaagtgaataactaattttggttcattttcaaagttctcttttgtatagtattgcttattagttgcaaatagtggttcatttacatttgatacatctctggcttctctgacattttcccaataatcaactatttccaaataatatgcactggctctataatattgacttcgttcgtcaatcgtattttctaactccttttctctactttccgcttcattttcccttatcaactcataataaccactaataccatagtcacttcctccatctgcctcacaataatttaatatctctacataaatgctatcatttctaaattgcatatgtaatgtgccactatttccccaaccatcatcagcataatcaaaaagcagctcgttctgttctatctctccactaatatcttcaacaacagcaaagcgttcagtcatttcctgttgagcaaacagcgtacccgtaagtcgattactttctgtaattgtacaagataattctactccaccttctgacaaaatctggtcatgcgttcttccatcatttgaccaattccccgtatacacttcataaattacgccatcttctttattttctatctcattctctgtctctgataaaaaattttcttgtttttcatcattagaacatcctgttccaagaactatcacaaacaacagtacaactatatattgaaattttttcatagtctacctccgcaccacttttaacagtattatatcatttagctcttgtttctgctattcaaaattattaagggcagtctgaaaactgcccaacatcacacatacaccatatctttcaacaccacttcttccgcacagtgccggatattgttcatcattcctacccactgcatttgattctccgacttcaactgcgccgtcactccctgctttgctttcatctgttccaccagtcgctccatcatctgataacattcttcgtccgtctggtgcagatattcatttaaatttccatccaacagcaattccagatacaatgctctatggtactctttcagatactctgctctcattcttccgtatctgccaatttcataatgcgttccctccgggagccggagatctggataatacagaccatcctctcccaaagtgtaactgattccgttttctccaatgatgtgctttctcaacacttctgtttctttgattttatccgtcatatccatctatctccttatctgctcattctgttctgatagcttctctgcaatcgcttctgctctgcctgtaaccgttccgcttctttcacattgtcaataatatcctgtattttgtcagccccgacatactgtttcactcgttccaaatcctccgctttctcctgcaaatgctccattgtgctattctgctccttgattttattcttataccatgcaatatcctctccctgctgatttacctttgcagtcagcttcttcacctgctccatcagacccacacacttaattgttaggctttttacaagttcctttaatcttgtaatcaatggtaatgccaccttttcacgataggatttcgccgactgcatcactcccggctctggaagctgccattgtttttcctcgtcataggctctcacattacgctccagagcgaccttagaacctgccatagcttccagttctttttgaagcttctgctgttgcttttctaattcccggttgccggacaaccgcctttccttttcctgctccaaatcctcattctcgaaaatcaactgactgttttttgccaacaaactgttataactctgctttgtatctacatacgttttttccagttctgcattatctgccttaatttcctcgttctgtctttgaaacttatctcccatctctgccaattcttccgcacgagcaagctgactgtccaccattttacttgctgtctgcaatgcaatttctgattgtgcaagctgagaatctagctctgctacttcctttaccctctcctgcttctcataatccagcaccgacagatgtttattgtgcgtacccttctgcagccattcaacaccatatcgttccatgactgccgcaagttcctttttctctgattctatccactggttccattctgttgctcctctggtgccgccttcaaatccctgctccgccaatgcccctttcagcgaaacccttgtatcaagtcctcgcttactcccggtaatgaccggaacaaaatcaatatgaatatgcggtgtttcctcatccatgtgcagatgtgccgagaatacatgaagattcggattcctgctttgaaagtctgtcatgaagtcaataagtatctgctttgccaactgcccctcctcactccgtgcattcatgtcatctctgttacctatctggaaaatcacttcgtaaaacagtttctcctgcttcccctgccggattttctcataatagttttcaatcttccggtcactgcgtttctgcttcgcattgtaccgttccagagcttcgtcaaacagttcatgatacactgcctttatatcctcgtgacaaaattccacattgtcccggctcctttctttatctacattctttgctgaaaatgctcttgtattgtgattcacagagcctttccccatcattccgctaatcgttctctccaataaaaccacctctcatctctttttatctgtatcttttagtgccgataggcacaggctttgttactttcgtcgaaagtaacgcaaaagcacttttgacagcttcgccatcaaaaatgcaacccgataaatcgggttttgcgtcctgccggaagctttttctgcctgcggcagttgtgcctgttccggtcacattgtcatcgctgtcaccgcaccatttttccttaatcgtttcctacgggtgcgtgccacgctcccgttttattcgtctaaggaaattaccatcggaagctgtccggcacaccacgcctgtctagatattccctgcgtgccttttccttttcttcctctgtcggtgcagttttatactgcgtatacagctctctcattaccagggcatccatctttttctccaatgccttaactatctccggctccgtttcttcctgccctatgagaaaatatctcacgagcaaaaagaacagttcctgcgaaatctgcacattcttcatttcaatcgaccaatcctttctgcaagaccgcaacaacgcaatgtctatatcttttgcaaccttgcaatcttcaagaccgcatttctgtatactctgcattgttgcgttcttcctctattcctgctttaccttatccagttcccagtaccaagcgttattgatttttcttgcccggatacccagctctttctttgcgttttccagtgttcgtttggaaattcccagttcttctgcccggtcaaagatttcgttgctcaaaaccgcattctgtgtttctgcaagttcccgtaacatctgctttgccagctccattttatttgcctttggtgcaatgccgccaagcacctcatccacagtaatctcataatctccaatccactgaaagccttcctctgataaggcaaatgccttcgggtgcccgaatgccgcaaggttattttttatctggacaacagctctggtattcggttctccctctacccgtccgaccagtaatacgcttcttgccactgcaaagaaatctatggaacccatgccccggtatgccgctttattgccggaagccttattcatatgaccgataaggataattgcacactttgttttctctgccaatgctcctaatttctttgtcatatcccttgcttcgtttgctcggttcatatccatgccaccgcccagataggcttgtatcgggtctaaaatcaagagccttgcaccagtccttacaatcgcttcttccaagcgttcatctaccatagacagtgacttgtcactctcatcaataacgataattctctcgcagtctgctccggcaagttctaatcttggttttactgtatccgcaagaccatcctccgcagtctggtatattacattgaccggctctgtgactttcatattttcatccagtgcttcgccctttgacagctttgccgccagattcaagaccattgttgtctttccgtcacccggatcaccctgaataattgtcagcttgccataaggaatgaatggataccacagccactcaatctcctgcgactgtacctctgacattctaatcatctttaattcaatcttctgttctgtcattttctcctccaattataattttataattgctaccggagaaaacctctgctatacttagcttgtatatacataggataacagaggtttatccggttatctttagtcctgacagttgccgctgttgggacttttttcttgttcattatccagcaaatctgcaattctccgttgctgattcggatataagtgaccataagtatttagggtaattcttatatccttatgccctaatctttcctttatcagaatcggctcaatccctttgttgatgagatatgctacatgtgaatgtcttaaatcatgcactcggattttctttactccggctttcaccatattgtgcttcatcttatgctgtactgcttcctgcacaatagggaaaagtctttcattctccggcataccgtaatgtccttcaataaattgctttatttcctgcttcaaaaattccggtatttctattgttcgcacagattgttttgtctttggttctgtaatcacatcctttcgttctgtcctatagtacgtttttgtgatgctgatttgatttctttcaaagtttatatctgccggagttaatgcaagtagttctccaattctgcatccagtccagaaaagaatttcaaagatgagataatatcttgttcccggttctatagtttgaataaactgctgatactcctctgttgtccagaaatccaagcttctgctgtccgagtttcccatccgctttaccttcttgcaaggatttgtatgcaaatcgtaaatccttgaagcatgagtaaacaagctggttagctgattttgtatcattcgcagatatgattccgaaaagccttttgtctgcatttcattctgccactgaataatctgcgaagctgatatttcactcatcatttgatttccaaaatacggaataatatgctgttccatcatataacgtttgtttttcatggtacgttctttgagttcattctgtttgtcctcaaaatatacctccataaattcactcaatttcatatccatacttcgactgctattgagttttttctgtcgctcatattccagagcttccttttttgtggaaaatcctctctttcttcgttttttcttttcgccctttgcattcgtttcaaaccactgggcagtccatttcttcgtgtctttttctttgtaagccattcctttcttctcctctcttagttcgcagccagctcgtatccgaacatcttttttgcccaatatgctcttggaatccgtcctgccattgtgatatatccctgctccgcaagttccttattcattgccttaaccaacttgtaagcatacgacttggaacaatccagttccttagccacatcatccgcactcatcatatattgatagttcgccatatattcatcctcccttctcattctacaattccgttacaactcttgtatttttgttgtgtacggttttcgtaaattcatattatcactgtccgtaaataatgtcaatacttcgtaaatattattttacggttttcgtaattctaaaattatgtaatttttacttttatgtttttcgtaaatgtgatatgataataattgaatttatgtttttcgtaattactttgtctatgaaaataggaggttgcttatgggcgatggaaagaaattaaaagagtaccttgatgaaaaaggtacaaatgtacgcagaattgcaaaagaaaccggcattagtgccaccacgttatacacgattattcaaaaagattccaatatccgctttgactttgcgctccgacttgccaatgctttagatattgatgtgaatgagatatgctctgcaagtcctttctctggagctattaccgaagaagaaatatatcccactcttccagatggattgaatggagccttggatgcaagcagagtcaaaacctacttgaaaaactctctctatccacttatgtacctattcggtaaaaatagtatgccggatgtggataatcttttgacttccttttatcagttggatgatgaagcaaggaaagaagtggtcgaaacgatacaattcaaactacaatatcacagagaccccgaacgggcagaacaggtaaaacagattaagggatggtaagaaaaaagctccgttgaatagcaaaattcgacggagtttttttttgcaccattttggcaccgctcacacccatcttcattattatcgcatgtaaaaagggttccggagaaatctccgaaacccttgaatttactgaataatatttaattactcgatgatagtagcaacacgtcctgatccaacagtacgtccaccttcacggatagcgaaagtaagaccctgctccatagcgataggatgaatcagttcgatggtcatctctacgttatcaccaggcatacacatttctacaccttcaggaaggtcacatacaccagttacgtcagttgttctgaagtagaactgaggtctgtagttgttgaagaaaggagtatgacgtccaccttcatctttggtcagaacgtaaacctgagcggtaaatttcttatggcatttaacgctgccgggttttgcaagaacctgtcctctttcgatttcagttctctgaacaccacgaagcagtgcgccgatgttatcaccagcctgagcttcatccagcatcttacggaacatttcgataccggtaacaacggtcttcttgctctcttctttgataccgatgatttcaacttcttcattcaggtgaagggtaccacgctctactctaccggtagcaacagtaccacggcctgtgatggtgaatacgtcttctacaggcataaggaaaggcttgtctgtatcacgctgaggatcaggaatatactcatctacagcagccatcagctcaaggatcttatcgccccattcgctgctgggatcttccagagccttcagagcggaaccctggataatcggagtgtcatctccggggaattcatactcgttcagcaggtctctgatttccatctcaaccagttcaagcagttccggatcgtctaccatatcacatttgttcatgaatacaacgatataaggaacgcctacctgacgggacagcaggatgtgttctttggtctgagccataacaccatcggtagctgcaacaaccaggatagcaccatccatctgagctgcaccagtgatcatgttctttacatagtcagcatggccagggcagtcaacgtgtgcataatgtctgtgctctgtttcatactcaacgtgagctgtggaaatggtgataccacgttctctttcttccggagccttgtcgatcatatcgaaagctacagcttcaccggtaccaagtcttaaattcagggtcttggtaatagctgctgtcagagtagttttaccatggtcaacgtggccgatggtaccaatgttacaatgcggcttgtttctttcaaatttagctttagccatttttgataatcctccttaaaatcaatagatataaattgtttctttttctaatcggctacttctgattatattagatactgccgatattttcaagctttatttggcaatcaaggcttattttgcctttgctgccaaaactttttccacaggaaaaggacaccgtccttattttgcctttgcagccaaaactttttcctgtacgttcttcggtacctgctcatatttatcaaagaacatagagtagttaccacggccctgtgtcttggaacgcaggtctgtggaataaccgaacatctctgcaagaggcacataagcccttaccatcttaccgccgccgatatcttccataccttcgatacggcctcgacgggagttgatatcaccgataacatcgcccatataatcctccggcatggtaacttcaaccttcataataggctcaagcagtaccggatttgccttggacatagcatccttgaatgccagtgaaccggcaatatggaatgccatttcggatgaatcgacttcatggtaggaaccgtcgtatacggtagcatgaacgcccagtacagggaatccgccgagtataccagctttggaagcttcttcaataccttcgccgactgcagggatatattccttaggaatagaaccgccaacgactgcggtatcgaacttgaaggtttcctcgccgttcggatccataggctcaaatttaaccttacaatgaccatactgaccacgtccaccggactgctttgcatacttgctgtccacatcaacgggcttcgtaaaggtctctttataagcaacctgaggagcaccaacgtttgcttctaccttgaattcacgcagaagtctgtcaacgatgatttccagatggagttcacccatacctgcaatgattgtctggccggtttccgaatctgtatgagcacggaaggtcggatcctcttctgccagttttgcaagggcttcacccagcttaccctgtcctgctttggtcttaggctcaatagccagttcaataacaggttcagggaattccatggactccaggattaccggatgctgatcatcacagatggtatcaccggttgtggtgaacttaaatccaactgctgcagcaatatcaccggaataaaccttatccagttcctgtctcttgtttgcatgcatctgcaggatacgtccaacacgttcctttttatccttcgttgcattcagcacataagaaccggaattcattgttcctgaataaacacggaagaatgcaagctttccaacaaacggatcagccattatcttgaatgccagcgcagaaaaaggttcctcgtcggaggaatgtctttccacttcgtttccatccagatccataccctttatagaagggatgtccgtaggagcaggcataaattcaagaacagcatccagaagcttctgaacacctttgtttctgtaagcggaaccacagcaaaccggaattgcagcacattcgcatgtagcttttctcaggacagccttgagttcttcttcagaaggttcttccccttccagatacatcattgttaaatcgtcatccagttcgcagattttctcgacgagttcggaacgatacagctctgcatcatccttcatatccccaagatcgtctgtaaccacaatatcttcgcctttatcaccattaaagtaataggctttcatttcaaacaggtcgatgattccctggaattcatcttccttgccgataggcagctgcaggatgatggcattcttgccaagtcttgtcctgatctgatctacggccccataaaagtttgcaccgaggatgtccatcttattgatgaaggccattctgggtacgttgtaggtgtctgcctgacgccatacgttttctgactgaggctcaacgccgccctttgcacagaacacgcccacagcgccatccaatacacgcagagaacgctctacttccactgtgaagtcaacgtggccgggagtatcgataatattgatacggtactcaggctcattgggatcaaccttacattctttatgcttggtccagtggcatgtggtagcggctgatgtgatggtgatacctctttcctgttcctgctccatccagtccatggttgcagtaccttcatgagtatccccgatcttatagttaacaccggtgtagtacagaatacgctctgtcagagtagtcttacctgcatcgatgtgagccataataccaatgtttctggttctctctagtggatattctcttccagccaaaggtttttcctccttaattttgtatcccgggcctaagctgcggggactctctcacacggattagaatctgtagtgagagaatgccttgttagcttctgccattttatgcatatcttcttttctcttaactgcggagccggtgttattagctgcgtcaagaatttcgtttgccagtctttcttccatggtcttctcgcctctcttgcgggagaaggttacaagccatctcaagcccagcgcctgacgtctgtcagtccttacttcgataggcacctgataggtggcaccaccgatacgtcttgcctttacttcgagaacaggcatgatgttgttcatagcttcctcgaatacttcaagagccggctttccagccttttcttctactcttccaaacgcaccgtatacaatcttctgggcaacacccttcttaccatcaagcatgatgttgttgataagcttggtaactaccttgtcattgtataaggggtctgccaatacgtctcttttctgaatatgtcctttacgtggcacggttcttccctccttaattataatctgcaattaaatcataggtactcacatgtgtctgatactaacaatacacgtaatgtgtattacactccatgtgtattacacgctgtgtgtattacactcaatgtgttcgtgcggcatatctgttcgcttaaaagtgaaaatcagaatcccaacactaaattagttcgctctgtggtacacggaaaataatgaattattttccagccttcggtctcttagcaccgtatttggaacgggcctgacgtctgttagcaacgcctgcggtatccagtgtacctctgatgatgtggtatctggtaccaggaaggtccttaacacggccgcctctgatcagaacaacgctatgctcctgcagattgtgtccttcaccgggaatgtagcttgtcacttcgattccattagaaagacgaactctggcgatctttctgagagctgagttaggtttcttaggagtagctgttttaacagcggtgcagacacctctcttctgaggagcggaagcatccgtagctttcttatgaagggaattgtatcctttctggagagccggtgcggtagacttctttacagatgtctgacgtccttttctgactaactggttaaatgttggcattctttttcacctcctgcggtataggttaatgtgttttaaatcgcatgcataagaaaaaaatgcatccaaatgcacgctagaatagtatacgtgcttgtgaatgcattgtcaatagattttattgaaaattactgtaaataactggtaaaaccttatatattgcggctgtcggcgctccgcagccctgcaggccgcccattattcggcaaataacagcttcagatgctcctccgcttccctcacggagctttccaccctcactctgattttgtccacacagccttcctcccggccgggcagaatatcgggaacaggaacaaaaggcatctcttcctgtaccttcctcattcttctttccagcgtttcccattcctcctcataatcttttaaaaaattatgggcttccttagtatggtccgcctgctgcctgcacagacttatagcctcactgatgcagaccgccgcctgtttcagcaggacatcccgttcgatcagctgtgcatgaagagaggccgcctctttatttttggccgccagaattccctggagagatgacagctgccgttttgcagattctatctcatacataagattatccgcttcttctctgccggtttccgtttcctgaaaagctgtaccgtcgtttcccatttttattaccctcataaagatcacgttttctgcttcccattttaccacagttccgatggcttgcacaggttccggcatcactttttattccttattccgacttataagctgctgttctacagtctgtcaaatgcatcctggctgaccggatagtagtaataaaagcctgtggcatagctgcatccgatgcctttgagatattcggcctgctccttgttttccacgcccatacatattaccttcagccccagatccttacataaattcatgatgctctgaataattttctttccctccggcttattcgtatggcgaataagatcatggcgcagctttatatagtccacgccgcattccaggtattcaaaaaatactctgtccagttcaagccccgacaggcagatatggaatccaaacccgcgcagtttttttatcgtttccataaaaatgtcggagcggctcatctccaccagctggttcagctggataacaatctgatcccgatccacgccatattgggataccgcaccgtcaagctcctgggggaactgttcatcccccacattttccaccgtaaaattaaacagaagcctcatacgccgccccttgtccgcctcttcttttaagaagcggcagccctggcggaatatatccatattcattttgcccgtcagctgcttccgcttaataacatccaggaaatcgccgggctgcagaaggcctcttcccggattctgccaccggaccaacgcttcagctcccgtgatactccctgactccatctcgatcacgggctgcagatacatgacaaattcctgatgcatcaagccatgaatcgcctcatgctccatggcatagccggtaaccgtctctttctctaccatttcatcatacacggtacattccacataatgattccgtgaaaattcagccgctatttccgccctctgaatggtcttcaacggctctgtctccaggccggacatccgatagatacccgtatggggatccagaaaatatcgtttctgccggctcttcatcgcctccgctatactggcataaatatccctgactctttttttaatgctgtccacactggtatactggagaaaaaatacaaaataaaactcattgaacctgctcatggcctccgagccatccgccagcatgggcacacagatatcactgatgatctgcagcgccatttccgattccggatagccgtaaatatggctgatagtatccagcccggcatccagaaataaaacggcataatgcgctctgtttccgtccgtaatctgctcttcgaatttctttttccaggccgtgaaattatctcctcccgtcagttcatcccggaaagcgagctgcactacctgtctgcgcttttttatcatgtatataatcaggaccagaataaaaataatcaaaaccaggaccgccgcccagacagcgaagacagaatttttctcaccctgatatgcatccttcgcatactgcacaagaagacctgccgtgcgctcctcattcacccgatacaaagcggcctccaatgtctcctcggcctcactctgcatgctcttggtatatgcgaggcagatatctatcctttcttccccatcctgaaaggatatcaccgttttccctttgtgcagtccggctgcctccagttccccgtcggtaagccccatcgtccataccgcatctacctgcatatttcctgccaggctcaggcggttatcctccttcgagccgttcacatatcgtatttccatgtccgcctgtccggcggctgtatccagtatctcaggcagtatgccctgataagaagctttttcggaatcgtagaactcaaacggccaggaatccggcatccctcccacatagatttcttccccgcttccctttattgtatgaaagggcataaaaagccagacaactgccgccgcagctgctgccgtgagaattccgtatttgattttaccctttttattttttcccctcaattttcttctccacattctgctctgaggactggttcagctgtattttctgccgctgaatctggccccatacatttttcttctttctataaccgataaaagccgtcattcttgtaaacgcctggataaaccggaaaaatacgctttccgcaagacacagatagattgatttcagtacgtccaggactgaaagcctgatattctgtgtatagatcctggcaaaaaaagccgtaatggtcagtattgccccatataaggcatagattaggaaaaacaggagcataaaaggcacattaatcagatttaccgcatatgccaggataatagtcagaagtccgaataattcaataaacggagacagcagttcatatataagataatataaataggatacataccctaccacaccgtattcaggagccagaaacatcctgcggtgcttcttcagacattggaacaatccgagataccaccggcggcgctgcttctgaagatcccgtatgctggacggacactggctccagcagatggcatccggcacataacggatactgtaaggaattttgttgattctgcagaaggaatgcagctttaccaccaattccatatcctcgcccatcgtacttgtatcatagccctttacggcggataccatatccttgcggaacaggccgaaggcacccgaaataatgagatttccgttaaatctgtccataaaaacccgggacgccataaaggaacgatcatactcaagaatctgcatcccaacaataggattccagggcatatggtaatccacaagctcgccctgcttcaaaacggcacagtttgaaatgcggacaaggccgcccaccgccactatggtatcatcctgcagcacaggcttcacgatttccttcagggaatccctctgcagcacactgtccgcatccatacatatgaaataaggatatctggccgcattgattcctacgttgagtgcgtcggcttttcctccgttctctttacgtacaagcgtaacctccactccatctatcacggtctcatagacatcgactacctttttgcttggaatctgctgattaatcggccggttcacctttctgagagggaaagcgtccagcagggcctgcgtcgtattgtcctttgatccgtcatccaccacaacaatttcatatagcttataatccatcatcagaagtgactttaccgtatccactaccgtgatttcttcattatatgcaggaaccacaatcgtcacgggcacataatagtcatgggatatttcattatggtatttcttctttttcttttccctgtacaattccagcgatccgtataataccgacagtatcaggaaagtagaatagccaagcagatatataacgaatatgacacccacacagctgtaaaaaagcttgattgcatcaaacatgccactgcccctcttccctgtccttacgtcggatctcttctttttccagaacgtaattcaatatttctctcgcataacggtctcttccgttatagatatcaaaaagcagcgttttcgataatcccaggccataaatcagggcctcggcacagttaagcctcacatgccagccggatgcgcgcaatccctccttcaggcagagtaccgtatcctcccccggataggaggaaagcgccgatgccgccatagccgcaaattcccagtccacatattcctgatagcgcacataattctgcagtatttccctgaccggttcatagggatatttacgaaaataccggattgcctccagctgtatttccttatcttcatttggatctgataaaagcgcggcaaactcctcacggaagtcccctgaaaagaaacgtataaactgcagaatcggcagcaccagttcagtgacaaattccgtacggtggccaaaaagcagctccgcaagctcccttctgtctccgctgaagctcaaaaggccgtctgcaagcagcttcctgctgtgataaatctcgttatcctccagcttcctccaaacggcaagaaccgcatctttatttcctatggaatagaaagccctcagggcattttctcttgcatttacatccctgacggtaatcatatccataagaaaatccatcagcccgtcaaaggtctcacgccctttgtcgattcccagatcggccacaagataagcaaaatacgcctgttctatcatgtcccttttacggtagacctcagtgagcctgagaaaaacaccacgcatacgcttcagatattcatcgataaattcttccggttcccgcttcctcacctccagcatggaatcctcaaaggccgccaggttttccgcttttttcaagcctctgaacatttcatcaaaatgagcggcgtccggttcttttccttccctcagcagttctgtctgttccgttatttttccgacaaaggacaggctgcttttctcccgttttttaccgctgtacttatccgcaaaaatgtagagtatattgaaaatcaatacggcaatacagctcgccatatagatgtaaagaataacttccggcttaaatgaaagcacatgcatatgcttcctccttgtatcagttggtttttcacgtcttaagtccatttttcctttaccgcataataagactgcttcagccgctcatgatacgtgggctttcttccccatccgttcagcttcagttcttccatctttattcttgcgcctttgtcaccggatgtccctgctccgacgtaaatactctgaatccggaggttttcaatcccgtaatgctcataataatcatcgtgtatctgctgctgcgcaggattagagaaattcagcagctgccagggcagacgtatttccacctcatcaccgttgatataaaaatccgaaaccgaattataatccgcatcatagggattgccgttcccgaatgtcatcttccccgtctcaaacttttcagacatcttatcctcttcatacagcgcattcaccattcccagctgcagggccagatatattttccgaaattccggagaattcttatccggaatattgaaatacggattttcctctccatagtcttctgcaaaaatggcccggaaagcctcatagcgctcctgcaccagcacccggctgttatcccttccgtccagcaccatcagaaagtctgcctgcctgtcaaatttcacatcctccccgtttgcataataactgcccgatttcggagttacatctatgggaatataaattttttcattctccggatcaaaattatctttatgcactctgaaatacagaaatttttcatcatacttcatgtaaagccggagattcccattatccatgagcaaatcatcctgtgtccactccccaacgtctccgtccgtatagcacacactccttttttcccccggatcgaaggccatcaggccgaaaaactgctcgttcgtctgaaaatcactccagtatgccgtttttgacaaatccacattcgccatggtattccaggttctcttaaaccattcgtcctgccaggagaaaataacgcagcctgcacagccggctctgcgaatatcatcatagctgtccaccagcgctttcccctgctcctgctccgacatatatccctgggaacgagcggtaaaagcatccagctgtgccctgcccctggaggtaggcgtgccgaattccgatatgaccacaggcattttatgatgcctggtaagcatttccagataaacgccatacgtattataatctccgtttgccagcctgtaatcctctgcaaaaggcacttcacctttccagctgtcataataagccagataatccggataataggaataaacatgataggatgcgaactgaccagacttataacgatccgttgacagaatatgctccacatccacttttgcacacttcataaaaagctttagtacctccggcggataatccagcggatccgtagtcggccaattggaaaaagcaagcagtctctgttccttatatttatcactttcataacggatcatatgatcccccacctccgccagcatagcctcaaagggagtggcatcctccgatgtgtacatataaagtccctgatagctgttcctatccgtatccatatgatccgtataggctacagtcacatcttcccattccacgcccagaatataccccagaacccagtctgatatatctcttgtatagacaccgcttgcgctggaagcctgatatcccaggcttattttctttctgccatgtattacgtccaccaatgtccggcagtcctgcagcagcacttcgcggaaggaatcgtcataggcatccacatgggaattctggacataatcattcacccatactccatggaggatataaagcggtgtgggattctctttattatactcatagaccgcttcataaaaatccggctccagtatggtataaacccggatagtattggctcccatttcctgaatcaggccaaaccaccgaagatatgtctccttatcaatggcgaactctgttgaaaagtatcctggtatccccacccccatatccacgccccgtatctcaaaaggctccatgccgctgcccgtatccagcagtatctcctttccctgcgtggcggcaaagacttcgatatcctgttccctgtggaaatcaaaataaattccccacctgtaataagccgtatccaacaataaatacagcaaaatgcatgatatagccgcaattaaaaattttttcaacttaaattgacctcaattaatggttaaacttcttatttttggattcatggctgtaagagagcaaatcctctatatgctcatccatccaccgcatatgcctgatcagacgtgtttcatattgctccatcgcctcttcataggaacctattttccggtaatcatccgataaaagatcattttccggaaggaaactgtatccccatttttcaaagttcctgtcaactgccgttccaagataatcacggatttccctgatattggcggtaattgcttcctcacttaaaatacccctgcgcagttcccgatacctgcttataattcgcttattaaaattttcatccttacaaagcatgaaataccagggacggctctgcataaagaatccggccataggcgtctgttcttcgatgtaattatcacagcagttattaaaatcccatacgcacattttcagcttgccggtgacatccttataaaaataggtggagtaaaggcctgcatccgtattctgcgccacctcatttatgatgaaataatcgacaaaactgtccacatcgatataattctgatatccgtagcgcgccgaatcataatcataggaatacagtgctttttcaaacttggaaaaatccctgctgatcgtctccgtcagttccggcgttaatttggaagtcccgggatatttcacctccagccttccgtatattctcctcgcatagcttgtaaaattctgcagatactgaacgtcattgacactttccctgtcggcacagacgatgtagctggataccccggctttcccgtcgtatttggtaacctctatccttccctctcccacgctgatctgctcggtcatgacatatacgccctgatactcctgattgagaaaaacctcacagaacctcacgtccggcgcccaatccatgatccttcccgaaaggttataccacatataattacgaatcagcgttttatccagaaaaggcccgtgaagcacccaggtactgtccttctccatacccattaccgcaatatcccgatcggaaccatcgtcttttgtaaattgaaacaaatatcccaccttatcaaataatctggaagaatttccgcggacccggatattaatctgtgaatcaatatccggctcggcagacagcgtattcagaactcctgccgcgtcatatattttcatatccgcctggatataggtatttacaatacttcttacatgctgtccttcctccggcctgcccggaattatctgtccgccggtctcaatactgacaatcggaaggtgtgtggaaaaggaatccgcttcaatggacagacttgtgtcttccacatccgtattataggttaaatgctgctggctccttttcttttcgggatcgatatgtctggaaaacatgagcgccgccaaaaggaaaagcaatacaagaccgacataaattttcctgctgttcatatttttacccgctgatttcatcattctgcgtcacaatatttacatactcgatggattccagttcatacagcatttccacaatacttttctcttttttattggaaagaagatataccttcctgggcatctcaaatatcagttctatcgattccctgctggtattcttcacacgcagcatggcttttgcttcaaaataatcaaaaaccaccgcctctatccgccgttccatatttcttgccccacggataataagaagcatcctgttatcgtttctaacccttcccaaaatcagaaggactgcaaatacggccgcgcttccggtcacagcaacaacatagtctcccacaccgcagcatatgcccacaataattgtccagaaaatatacgccgtatccctggagtccttaatcgccgtacggaatctgacaatggagagcgcacctaccatacctaaggaaagagcgatgttgttgccgattaccgtcattacggtcgccgtaagaattgtcagcgccaccagtgatacattaaatttcttcgaatatacgcctcccgcatgggtgaagtagtaagacagatagatcactccggaaagaataaccgccaccagtatatgaagcagaatttcttccacagtcagcgatccggattcctcaaacaatgtatagatatattctttcatttttatattcctttccccaaacggcaggaacgccgctgctttatattccttctgatataatctttaaaatacatagtgaagccctgcacttctggacaggcagtatttgctgacagaagttgccgattttccctccaggcttaccatctgtttaatataactgagcataaatccattatatttcacttccattaccacaagataaggatccaatacaggattctggtttaatgtgggagaaaaaaggcggaaatcactttcggtcgccttaattgcaaaatcgaaggtaattcttgttttattttcactggccacataagctttcctctggtattccacgattgccttcggcctgtaacaaaacatattcattagtccatagcattccaccgcaaaggaattctcatatttaagaagacaggaatactgtccccggctcagttcatccgcatcctccttactgagacgcagggaacgctttttctgattttcaccctgtttttgtttcatctccagcattgcaaaatcagaatccggcgaataggttctgagcctgattttccttcttatctccagcccgtcttccttttcatagaaatccctctcctgcattgtgtcaaaatacaggctcctgataggatatccgtaggttccattatgggaatccgggcgaagcacctgttcaaaggtatgatcgagtctgcggaactgatcataagataataaatattttttttcctgcctcagcacttcattcatttatcattcctcttcactcgctctccgcttccataagctgcagacatggcctcagataatgccatgaaaaaccgaggcgtttatagggatactttgctttcagcttttcccagctatccgcaactgcctcaaagccgtcatcataatacgtgttttcttctgtcagtccatgatagccctgcatctgcatctccgtaatattaagaatccccttgccatatttttcagccagcctgagttcttcctcaatttgcccggcttcattcttcttgttataattcatgactgcgattccgtcacagccctcttcaattattttttcaagcaattcggataagccgatccgatcataaaaattaggaatacaaataataacagccagcttttcttccctcgctgactgatatgcctgaatacagttggctgcatactgttccatacagctctcctgattgtcatcccattcttccagaagatacggctccacatcgaaaacaatgccggcaaacccaccttccgttccgctctttttattccattccgccgtgattctcaccgcttccagcatggatgccccatcctcttccacgccccagtccgaggctccggccagataatagacccgctgtcctttttccttccgccttttcagataatccagaacctgtgtctcctccgtttccggggatatctgctgataaacagccttgcagttaagcttttccatagctttttccacatcgtcttccatttccggaaggatatattcctcctcccatgaaaaaatgctggtctcacccacaaagtcttccgccttcttttctctccagctgcagcctgtaagcatcagtgaggctaactgcatacataatccgctgattaaaatcaaaccgctcctctttcttttcattttatcgttccccatactttttattctatcggcagaaaatcgagaaaatttcttgtttctttaaaaaatactaaataattataaaaaatcaaggtcatcttattttactgttctgatgatatgtttattatttaatagtaacattaacaatgattactgacaataaatattactatattaatatagccatattaatattccgaaagatttactattcttttttaaggtaataaaaaacaggcatggaaaattccatacctgtttttaactctgttctcttcaattcatatctcagttgtgattattcattatcttccggaatggaagcagccagttcatccgcttcttccccgccttcataatcatcagcctcatccgtaatgatatccacctcgtcatccggcagcagatcttcgtccatgccttcatcgaaattgaattcatcatccagatccagcatatcatccattgcgatatccgtattcagatgtacgtcacggtaacgcttcataccggttcccgcaggaatcagcttaccgatgattacgttttccttcaggccgataagaggatcgaccttgcctttgatagccgcctccgtaagaacctttgtggtttcctggaaggaagccgcagacaggaaggagttcgttgccagcgcggctttggtgataccaagcagtatctgcttgccgtctgcgggctgtttttcctgtgcagccagttcttcattcagatcttcgtaatccagcgcatccacgagtgttccgggaagatattcggtatcaccgctgtcttccacacgtacctttttcagcatctgacgaacgataacctcgatatgcttatcactgatatcaacaccctgcagacggtatacacgctgtacttcacgaagcatgtaatcctgtaccgcacggattcccttgattttcagcaggtcatgagggttaacgctaccttctgtcagttcatcgccagcttccagtatctgtccatccataattttgattctggaaccataggggatcagataagctttggactcaccggtttcattatttgtaatgataacctcacgttttttcttggtatccttaatgaccgcaacccctccgaactcagcgataatcgcaagtcctttgggctttctggcctcaaaaagctcctcaacacggggaagaccctgtgtgatatcatcaccggcaacaccgccggtatggaaggtacgcatggtaagctgtgtaccgggctcaccgatagactgcgcagcgatgatacctactgcttcacctacctgaacagcttcaccggtagccatgttggcgccgtagcacttcgcacagataccgtttctggaacggcagcttaatatggtacggatctttacgctttcaatgggctcacccttatcattcactcctgtgctcaggattttctccgcacgggtgggggtgatcatgtggttgctcttaactatcacattgccgtcacgatctttaatatcctcacaggataccctgcctgtaattctgtccttcagaccttcaatggtttccttgccgtccatgaaagccttaacctccatgccggggatttcagggcgatcttcacagcagtccatctcacgaatgatcagttcctgtgatacgtcaaccatacgtctggtcagatatccggagtcggcagtacgcagagccgtatcggacagacccttacgcgcaccatgtgcagacataaagtattccagtacgtccagaccttcacggaagtttgatttaatgggcagctcgatggtacggccggttgtatcggccatcagtccgcgcatacctgccagctgcttgatctgctggttggaaccacgggctccggagtctgccatcatgaaaatattattgtatttatccagtcctgcaagcagaacgtcggttaattccttatctgtctcgttccatgtttccacaaccgcacggtaacgctcttcttccgtgataagaccacggcggaagttctgggaaatacggtcaaccgtagcctgggcctctgccagcatttccggctttctttcgggcactgtcatatcggaaatggaaacggtcatggccgcccttgtggaatatttataaccggtagccttgatatcgtcaagtacctctgccattctggaagagccatggatattgataaccttttccagaatctgcttcagtccctttttgctgacatggaaatcaacctccagcttcagggcattttccggattgcttctgtctacaaagcccagatcctgaggcaggatttcattaaagataaagcgtcccagtgtggattccaccacatcggaaatttctgtgccgtcagccagctgcttcgtaatcttcactttaattctggagtgaagggtgagcacctgattttcatatgccagaatggcttcattcaggctcttgaaatatttgccttctccctttgccccgggtctttcctgggtcagatagtagatacccaataccatatcctgggaaggaacggcaaccggaccgccatcggacggcttcagcaggttattgggagacaggagcataaaacggcactctgcctgtgcttccacagaaagaggaagatgcacggccatctggtcaccatcgaagtccgcattgaaagcggtacataccaggggatgaagcttgatagccttaccttctaccagaatgggctcaaatgcctgaataccgagcctgtgcagagtaggggcacggttcagcataacaggatgttctttgataacatcctccaggacatcccatacctgggaatccagtctttccaccagtttctttgcattcttaatattctgggaaatacctctcgccaccagttccttcataacgaagggcttgaacagctcgattgccatttctttgggcagaccgcactggtaaatcttcagttcggggcctacaacgataacgcttcgtccggaatagtcaacacgcttacccagaaggttctgacggaaacggcctgatttacctttcagcatatcggaaagagatttcagggcacggtttccggggcctgttaccggacggcctcttctgccgttgtcgataagggcatcaacagcttcttgaagcattcttttttcgttacgtacgataatatcgggagcacccagctccagcagtcttttcagacggttatttctatttataatcctgcggtacagatcgttcaaatcggacgtggcaaaacggccgccgtccagctgtaccatgggacgaagatccggagggattaccgggatcgcatccagaatcatccattccggacggtttccggactcacggaaagcctcaacaacctccaggcgcttaatgattctggcgcgcttctggccggtggactccttcagccctgttttcagttcttcggattctttttccaggtcaatggcttccagcagttctttaatggactcagcgcccattcccgcacggaacttgtttccccaggtttctcttgcatcctggaattccttttcagacagcacctgcttatattccaggttgctttctccgggatccagtacgatataagaagcaaaataaagtaccttctccagcactctgggagacagatccagaatcaggcccatacggctgggaatacctttaaaataccagatatgggaaaccggcgcagccagttcaatatgccccatacgttcacggcggacgcttgatttggtaacttcaacgccacatctgtcgcagacaacacctttgtatctgatctttttgtatttgccgcagtgacactcccagtccttggtaggcccgaaaatacgctcgcagaacagaccgtcccgctcaggcttcagggttctgtagttgatggtttcaggcttctgaacctcacctctcgaccagtccctgattttttcgggtgatgccagaccgattttgatagcgtcaaacgtcatcggctgatatacttcattttttgtagttgtttcagacattgtgcactccttccaaaacttttccggatgaccggcctgccttgcggcagaccgttttcattatcataaggatggctcacataacatgacatccgttatttgtccatacagatgcagattaatcaatgatttcctcaaagctctcatctatatcgaattccagatcatcagcggtgtcctcatcctcagcggtcaccagttctccgctctcgtcatcaaattcctgtgcctgatatccgagttcaccaagagattctttttctactttgtcgaaacctttggagtcgccttcgatttcataacggtaatccgtatcaccgtaatcaaccgtttccatgatttccacttccgtattatcctcacgcagaacctttacatccagtgcaagagactgcagttccttcagcagaaccttgaaggattccggaataccgggttcaggaatgttttcacccttgataatggcttcgtaggtcttcacacgtccaaccacatcatccgattttactgtcaggatttcctgcagggtataagcggcgccgtaagcttccagcgcccaaacttccatttctccgaaacgctgtccgccgaactgtgctttaccgcccagaggctgctgtgttaccagggagtaagggcctgtggaacgggcatggatcttatcatctaccagatgatgcagcttcaggtaatgcatgtggccgatagtaacggcgctgtcaaaatactctccggtacggccgtcgcgcagccttaccttaccgtctctgctgataggaacgcccttccataattctctgtggtctctgttcagcgacagatactgcagtacttcgggacgaagttcttctttatgctttgcttcaaattcttcccaggtcaggtttacataatcgtttgccagatccagggtatccataatatcattttcgtttgcaccgtcgaataccggtgttgccacgttaaagccgagcgctttagcggcaagggaaagatggatttccaatacctgtccgatattcatacgggaaggcacgcccaggggattcaaaacgatatccagaggacgtccgttaggcagataaggcatatcctccacaggaagcacacgggaaacaacacccttgttgccatgacggcctgccatcttatcacctacggagatctttctcttctgggcgatataaatacgaacggcctggtttacaccgggtgaaagctcatcgccgttctctctggtaaataccttggcatccacaacgataccatattcaccgtgaggaaccttcagagaggtatctcttacttctctcgctttctcaccgaaaatagcacgaagcagtctttcctccgcggtcagctccgtttctcccttgggagtaaccttgccaaccagaatatcccctgcgcgcacttccgcaccgatgcggataattcccctgtcatccagatccttcagggcatcatcgccgacaccgggcacgtctcttgtaatttcttccggccccagcttggtatcccttgcttcggcctcatattcttcaatatggacagatgtataaacatcctcctgtacaagtctttcacttaaaagaacggcatcctcgtaattgtagccttcccatgtcatgaagccgatgagagggttcttgcccagagccagttcgccttcctgggtggaagggccgtctgcaattacctgccccgcgctcacatggttgcccttgaacacaataggtctctggttatagcagttgctctgattgcttcgtgcgaatttggtaagatggaattccatcttttccccgtcatcgcaggtcatcttaatcagattggaggatacataatctatcgtaccgggcttctttgccaccacacacacaccggagtcaacggcagccttcacttccatacctgttcctaccgccggtgcttccgtggtaagaagaggaactgcctgacgctgcatgttggatcccatcagcgcacggttggcatcgtcgttttccaggaaaggaatcagggccgtagccacagaaaataccatcttgggagatacgtccatgtaatcaaacatggccttgggatattcctgtgtctcttcacggtaacggccggatacggaattccttacaaaatgcccttccgcgtccagggcctcattcgcctgggccacatgataattatcttcctcgtcagccgtcatatacacaacgtcttccgtaaccctggggttagccggatcggatttgtcaatcttacggtagggcgcttccacgaaaccgtactcattaattctcgcatagcaggccagggagttgatcagaccgatattgggtccttcaggagtctcgatagggcacattcttccgtaatgggaataatgtacgtcacgtacctcgaaacctgcacggtcacggctcaaaccgccgggtcccagcgcggacagacgtctcttatgggtcagctcgcccagcgggttattctgatccatgaactgggacagctgggaggaaccgaagaattccttaacggcagcctgtaccggtttgatgttgatcaaaacctgaggggaaatttcttccgcatcatgagtggtcattctttcacgaaccactctttccatcctggacagaccgatacggtactggttctggagcagttcgcccacagccctgatacgtctgttgcccagatgatcgatatcgtcatcgtttccgatgccgtattccagatggatattataattaatggaagccagaatgtcttcctttgtaatatgcttcggtatcagctcatgaatgtttttccggatagcttccgccagttcttccggatcctgggaatattcttccaggatctgcgccaggacaggataatataccagttcggtaacgcccagttccctggggttgcagtccacataatgggtgagatcaaccatcatgctggaaagcaccttcacattgcgctcctctgtctggacatagacgaagggtaccgcacagttctggatggtatccgccagttctgctgtcaccttggtgccggcagctgccagaagctcccctgttgtggtatcgattacatcctcagccagtactgcgccgcggatacggtttctcagcataagctttttattgaatttatatctgccgactttggccaaatcatatcttctggggtcaaagaacatggcattaatcaggctttccgcactttccacgctcagaggctcgccgggacggatctttttatacagctctaaaagaccctcctggtaattctcagaagtgtctttggaaaaacttgcttctatcttgggttcatcgccgaacagctctcttatttcgtcattggtgcctacgcccagagcacggatcagaacggtaatgggaaccttcctggtacgatccacgcggacataaaatacatcattggaatctgtctcgtattcaagccaggctcccctgttaggaattacggtacagctgtagagcgtcttaccaattttatcatggccgattccataataaattccgggtgaacgaacaagctggctgacaatgacacgctccgcaccatttataacaaaggttcctgtctcagtcatcaaaggcagatcgcccatgaagatttcatgttctgtaatctcttctttttctttattgtaaagacgtaccttaacttttaaaggggccgcaaatgtagcgtctctttctttacatttctcgatagaatacttcacatcatcttcgcacagttcgaaatccacgaattccaggcttaaatggccactgtaatcttctattggagatatatcgtcaaagacctctttcaggccttcatcgaggaaccactggtaggagtccttctggacttcgatcaggttcggcatctccaaaacttccttctgccgtgaataactcatacgcatgttcttgccggtggcaattggacgtattctgttcttttccattgacatttcaccccgttcttatgatttgtttaccattcgtttccgcaaaagcactgtacgcgccccagggaaaagcaaacgaataggcgtctgccggcaccaacagaaccctccggcaggcagcttgatattagtttatcggtttttcgcacaaaaatagcataacttaccacaatagtgcactatccattctactacaaggaatttgggaagtcaaccaatatttttgtaaaattgtggataactttggaaatgaattacagttccgccggattttacccctcgcggcagtcgccaaggccaagccagcttggctttggcacgttgcccgcgggaataaaaagaaacctctgccgcactgaatagaacagtttggcaaaggtttctgctatgtcattccaaagtctgaagcactcctgattatttaagagtaactttagcgccttcagcttccagtttagccttgatgtcttctgcatcatctttggaagcagcttccttaacaaccttgggagcgccgtcaactacatctttcgcttccttcaggccgagtccagtaacttcacgaacaactttgataaccttaaccttgttagggccaacctctgtcagctctacgtcaaattctgtcttctcttcagctgcttcagctgcgccagcacctgctgctgcaacaacaacacctgctgctgcggatacaccgaattcttcttcacatgcttttacaagatcgtttaattctaatacagttaattctttgattgcatcaatgatttcctgagtggataatttagccattttatttacctccatttaatttgtaattgatttgcttatctgttacggattattcagctgcgggagcttcttctgcagtctcagccgcgggagcctcttctgctgctgcagcgggtgcctcacatgcgcctgcgccgcctttttcagccagctggttcatgacacgtgcaaaattggtgataggtgactgaatgcttccaagcagcttggagagcagttcttctctggaaggaatgagggaaattgcagccatcccctgtgcgtcatatacagtgccttccacgacacctgctttgatttcaagtttgcttgcagtctttgcgaattttgcaagttctctggcaggtgctgtagcatctgcgttggaaatcgcaattgcgctgggtccttccaggaaaggtgccagtgcttcaaagtccgttcccttgaaagcaaagttcatcattgtgttcttgtaaactttgtagttgattcctgcttcacgaagctgtttacgaagagcagtatcctgttctacggtaagtccgcggtagtcaaccaatactactgactgtgcgtccttgatcgcttcggaaatctcagcaactacaggtgctttaagttcaacttttgccatttctttacctccttatagatttttctgaaaacgagttcagtgccgaaaaggagtaaacgccgctgcggccggaagccctgaggcttcagcctgatataaaaaacctccctgtgaagccacagagaggataagttacgtaaatctgcgttaaaaacgttaactcttttcctcggcaggcgttcgttccttataccgggctaccggtacctgctgtcttcggcttggtcaattaagaccttactcagactatcataaaacatttttcttgtcaatgctttttttcattcttccggcatctttcagggttttgtaacaggtttatccatagacagtcctgtggccttaccgaattggcgcgcccattccggagtacggtaaaaaacaagggctccctggccgttatcccctgtgacaaaaaaacgctcctgcgcatccgtcttttccagtatactgttcagcacgcccaggatatccccgtcgatccagtcatactgcatatccattttccagctgtaggcctgcccgtccagctgaaaggcaacgatcacgctgccggtccctttttcccagtccaccttatccgtatcttcccttatatcctctataccgtcaagagggcttcccggcgccagtgccagcattccctccaaaacctcaatataatcggtactgatatcccagccctcaaaatcaaaccagaacagttcctgtgaatagccgtcaatattccagtcttcatcataggagggagatcccatcccggtcagcagccacgtataaggataaccttccacatatgcccgcatcctctgttcttccataatggagcgcgccgactccaccgtttcctccggcacttccagccccatggataaaagtacttttacctgtgtatccaaaggcacatattccggataatcttccggccggaattcctcttcccagcccggaactgtttcatatacggggttttccaggctttcccggatcaggcgcgtatttctgtacagcacgaacccggcagcgcccaataccacaagcagcatcaggatactgatcactatgccgagcacccagcccggccagtattttgcacgtttccccggagtatagacaaggcctttgctgccgcacagggcacacatgtcggccgcctgcccggcgctcaccatgttttccttgggaatgggaatgaactgtgtccggtttcttttaaacaggaaaaacaaatattccgtttccacaatccagccgaaatcctcccagggcaaaaagctcttgcttccgccgccaatcctctcaataataccgtcttccatcaattcgatttcccacgggccataaatatcattctgcacatctcccgtcttgaggcggcggcgtatgccctgttccggatttcccttccattttaccaaatttgcggaaaacagaagcacaaacaatatgaccggaaaccatgcgttggggtcgtcggtaaagagataccagcacagcgttcccacaataaaaattacggcatatattcctgtcaccagcatctggctgcggggaaatccaagggttcccccgttaatcacccctatagcctccctgtatatccatatccatttttcctgttccataaaaaaggaaaaactaaacgtacccggctgctccccggaagacgctgtttgctgtcccggagccatttcctgtgcctctcttcccatggcatccggaaaaggtgcataacaggcaggattacggatcagattcagaaacgcttccagcacctgctcattttcaaacacccgcagcggcatgggataccaggcaaaacgttttttggcctggggatatcccagcatgagtatatttcttgttttccggattgcggtaattcggctgcacggaatttcggagtagccgaatgcgctgcatttaagcatcccatcctccacccacatgatgcgcctttccaacaaatgttcttttttcaggaaacggcatgtacgcaccacatcaaaagcaaccgctgaaagcaaaaaaatcagcaggacaatgctgaacaccgggacgattaagaaatccaccgcacaaaggataagcagaatcagccacaggaaagggcgtttgcagtatacatcggccaccgcccggaagctgaattcacgcagttctttttccgtaaaatgaaaagtatattttgtctgttccatatgctgtcctcatgaaaagcggcgggtggagtcattccacccgccgacagaaccccggcgcggctgccggacagacactcctgtatgtccgctgcgctgccgtccgtgagtattaataactgctgtcaccgccatcgcggaaataaggatccgcctgttccatatttttagccggattatacttgatattcaggaactggtcataatttttctgatagcaggtttccagctctttgctgtagccgataaccatttgaggctgctcttctccatagaacttaagcgcctcctgggtatgtgattcagaaagattaattgcaaaaattttccttgctgtcgtataaagcttcatctggcttacactgtttcttcctgtccgtctgtaataatatccccataccaattcactgttcggcagaattttcgctttagggccatccatatacaccgtccattttcttcctacccacagactgttcccaacgggatgggcctgggagaaatctgactcgatcgcggctatggataccagggaattatccctcaggtatgcattgatggaagaagcatagctgctgttgaaatagtttattatattgtagataaagtaaataaggaatgcaagagccgccgccatgcagacccagaaaaagcttaccgcctgtccgccgattttggccgtatccacagtataaaggtaaattacatcatattcactttcttccacgcccatttcatccagcgtttccttatagtatctttccagctgtgagctgagtctcgtccaggtaccggtaaccgtggttgtctccggaggcgctaccgtcccggtttcatcaaaccagtaatcccaggtcttatcgatctttttattaagatcggactgcatattcttattcatgtaaatactgtaataataccagatggaagcattctgctcataatcatcaaatgaattgaacacaatatagctgttgccgtctatcctggtgcttttgcttcccgatgaggtattggtggttgtggtgctgtgttccacataatccgtaaggtaattttccacatcaatggtaacgtatttcccttcataagcatccggagatgatgtaaggtcaagttttgtcggtccggtgatcacatcaaaaattgcaaattttgtcaaagccagcagaccaattacaacgattatggatactatcgctctggtgagccgtgattttccggattttttcttcaatgtctccagcatattcttttctcccctcgtatctgttgttttttatgtaattagggtttggtcacaaacccgtttccgtcaatcaaaacctccggagaaaggctctgcatataacggattaccctgtctttttcactgccggcaagcagggaggtataacaatccttctgaagtgccggaatgaactgaaagttcttcagtgctccgctttcactgtcaagtgtaaccttaaccaggcaggtgtccagtgttttggagttaaacaggaaatttcccaggctgtaaattacgggagtttccccgtaataagtgatcccctgcagcacatggggatggtctccgatgattaaatcagctcccgccgcggctatcttgggcgcctgttccttttgggcccagtcaagctctgaggtgctttccgttccccaatggatataaaccaccacgaaatcgttttccgccttcgcctttgtaacttcctcaagcagcatatccacgttccggcagcggaatactccgggcgagttctccgtcgcccctttggtatccggattatccacccgctctatctgcgttgcggaaaggaacgcgatcttcacatcgcctgctataaaggaaacaggctttacggcttcttccaggttcctgccggcccccacatagggcatgcctatggattgcagcgtatccagcgtatccgtgagggatacctctccatagtcataggaatgattattggcaagagataccagatccgcacccatatcaatcagatatgacgcataagccggatccgcccggaaggtaaatgtcttacccggggtcgggcttccccttttcgtataggtaaactcattatttaccataaaaatatccgctccgcgcatctgctctaaaagctccggggcaatactgccgtctatcccttttcccctgcttttcatcttagccataacagcatagccgtcgtcgaacagaatgtcaccggcaaatacaagcgagatctcaccctccgccgatggggttactgcataaatattctgcgccgccatcgcttcgggatcagccagggtatccgcatacttcccggtatcttccttcacatcctccgccgcttccgccgtttccccattaaaaaaggagataacctccccttccacggagacagctgccaaagctatcccttcgtttcccagaaaagcccagctgacaagaagcaccgcgctgccaagtgagattgtaatgatcagcgtcagaaaaaaaatactgaatctgcctgtttttttcttttttttccgcactgccaaaccgtttcctcccgctctctttcccggatatttttatactcctattatcagggctaatcctcattccgtcaagtccgtaacataaaaaacacggccgattcttcggccgtgtccgtattaacgcgagaattaatatttggcaacagatacctttaccccaggtcccatagtggatgccaaagtaatgcttttcagatactgtccttttaaagctgaaggttttgcttttgtgattgcatccataagtgcattgaagttctcaagcagcttttcttcagtaaaggaagcttttccaaccggaacatgaacaatattggacttatccagtctgtattcaattttaccggctttgatatcgttaatagctttggttacatccattgttacggtaccggccttagggttgggcattaagcctttgggtcccagaaccttaccgagacgtccaaccacacccatcatgtcaggggtagcaacaacaacgtcaaagtcaagccagccttcattctggatcttggggatgagttcgtctccgcctacataatctgctcctgcagcttctgcttcgttaactttatcaccctttgcaaaaaccagaaccttaactgttttacctgttccgttgggaagtacaacagcgccgcggatctgctgctctgcatgacgtccgtcgcagcctgttctgatatgaacttcgatggtctcatcgaatttggcggtagctgttttctttgccagtgcgattgcatcagcaggttcataagcggcagcgcgatctactaatttagcggcttcgctgtattttttaccatgtttcattttcaattcctccgttggttattaacgcagtacttgtgttttcggcctctccctgtgcggaactgccggaatactgctcccaattaatttgttttagtcttctactacaatacccatgcttcttgccgtaccagcgatcatgctcattgctgattccaggcttgcagcattcaggtcaggcatcttcatttctgcgatttccttaaccttatccttggagatagttgcaaccttggtcttgttcggaacaccggaaccggattttaagttgcatgctttcttcagcagtactgcagcaggcggagtcttggttacaaaactgaagcttctgtctgcgtaaacagtaattacaacggggatgattaaatcacctttgtctgctgttcttgcattgaactgtttggtaaattcaacaatgttaacaccgtgctgtccaagcgcaggaccaaccgggggagctggtgtcgctttaccagcaggaatctgtaacttgatgtatcctgtaactttctttgccatgtcaggcacctcctaaatataatgtggtatggcgcagccggaatgcacgtgattcactcacgcggcccgctccttcgcccgaagaggaatgaagccggaacgctgcttccacagttcaacggattactccattaaacatcaaactattgtgatttacgaacctctgcaaaactgatttcaacaggcgtttccctgccgaacagctccacattaatcgtagcggtctgcttgctgtagtcgattctctgcacaacgccgaccgtatccttccaggcccctgcaacaacaacgatcatatcgccctctgcaaagtcgatggaaacattctcttgcttaatgccaagcggcttcatttccgcttccgtaagcggcaccggtttgcttcccggtcctacaaaccctgttacacctctggtattacgtacgacataccaggtatcatcattcatgaccatgttaatcaggacatagccggggaacatcttcttctggactgttttccttgctccgtttttcatctccaccacatcctgcatggggacgcgaacctccagaatttcttcttccaggtgcctgttttctattgtcttctcaatgttggcctttaccttattctcatatccggaataggtatggaccacataccagtttgtttctgccatacgttacccccactgttattttacaaggaaatcaactgcatactgaaggatcatgtccaatatggcaatgacgcctcccagtacaattgaaaccccaacaacagcaacggactgtctcagcagcagatccctgtccggccatgtgatttttttgaattcagcttttacaccatcaaagaatttcggcttggacgctttttcttcacttgaggaatttcccattacttacacctctctgtccgttgggctgattatttggtctctttgtgcgttgtgtgcttcttgcagaatctgcagtatttgctggtttccattctgtccggatgtgttttcttatccttcgttgtgttgtagttacgctgcttgcactccgtacatgccaatgtgattcttgtacgcatggtattctacctccttgcttttctctgttaacctatattttctcacgatagtttcccgtctttatccattcaatgaataccgacaaacgcccgtggtcaatcccctcccgggcaattgacgtatccggtcttttctgaattttaagcataaaaaaaagacctaaatctcatctcgccatatgactatagcacaggatatcccgtaaagtcaagcattttcataataaagggatacgttttgaatttcttttgcacacaggcagaggctgtagtccggactgaagggaatgctgcgaagctgtatgccgttgatctcctttgccagcccgtcctccgaagcggcggaaaacccgccgaaatcctcaccgataccgctgcctgtgaacttcacatagctctccttcgccgcccagacgtcaaagaaatcgcggtaattgttctttttcagatattcattttccagcgggtggaaaaaacgctttgaaatatgttctcttcttccttttgtatgctgctgcagatccaggcccacctcctgggcagccatggcgcaggcccagaaatccccgctgtggctgatggaaaaatgaagccaggggtattccgggaaataaggcttgccccgcagtcccttctccacccggaatgaagcctccttcgaaggtccttcccctccttccccaaaagcataacgggccgccgccctggaaaggaaaaggggggactggcttttatcatcccgcttatcctgcatacggtaaatataaacagcaatcccttcctttttctccatcatctttaaacctcaagccccttttcttccatataagagataacgtccttaacctggtgcagctgccacacatccctgttggggatcgtcgtatcaaaatattcctcaaaggcgctgacaatattcatgatttcataagagttcagcctcagatcctgaacgaaatccgtatcgtaattaatatcatttttacctgtaacctgaaaaacaatttttcttatcagttccagcatttcaaatctctccttctttcagaccatatgtctcttgatttttttggaagcagtcttggaaaactcctgctctcttatattcaccatctgtacctgctgataaaagggaaggtgggaattgattttgtttatctcctcctggagctgctccaggatctcataagaggaaaggccctttgccctctccggatccggatagatgctggccgccagcttcacatcatccgcagaggccccgctcacggccccgtataccagcacatccttcacaagggggatcatgccgattttttcctccagcttctcgggagagatttttttcccgttcttgaatacaatcaggttctttttacgtccggttatgtacaggaagccgtctcttcccaaatggcccagatcacctgttttgaaccattccccctgcatcacctcggcggtcagctccggtgacttataatatccgttcatgacatttttgccgcggacaaggatttcctcattttcgatcttcacttcacagtggggaagcacatggcccaccgaatccatgtcataggaataattgctgtttacggataccagaggggagcattcggtgatgccatagccctgaagcaccagaatgcccagcataaggaattcttccgcgatttccttattcagatgagcacctccgcagatgatggtgcgcagggtgcccacacatttctgacggacatcctccagcaccttgatccttgttttaatgcccatttttctcagcacacgctgcagacgcagaagacggcggagcccttcttcctgtccctccctctccgcattcagccagagctggttatgaatggcttctatcataaggggcacggtgagcatggattccgcccgggacagatgcagatcccgcatcactgttttcaggtctccgttgataatcagggccgcccctctcaccagggtggcgagcaccgcacaggtcataccataggtatggtaaaaaggaagggaggtaaacaccctttctcccgcggatacatagacgctggaatcgctggcattgtagagaatggcctggttgctgagcataaccggtttggaaatgctggtggtgccggaggtaaaggcaatagccgccgtctgtctcgcttctatgggaggatataccgccggtccgttctgggcaagatagttttctccttcctcacacagccgggaaaaagttaaaacgccgtcctccttcgcatcccccagaagcacgaacatctgaatccgctctttcccttcgggcacctcctcacagatgggaaggcatacatcggaggcaaataccgcttccacctcagccatctgcatcatctgccatatgctttcattcgactgctccgcgtcaatacataccgctgttcccccgcaggaagccaccgccagataggtaactatccatgcatagctgttttcacctactatggcgatatttttgcccgcaagcccgcggccgcagatggcccctctcagctggccgacttctccggcaagctcccggaagctcctgctttcttccgtccggttccttaaaaaccatgatacggcggttttatcaccgaattccttctctattccgtccataaatgcatcaaaggtatcgtaataggtcacatcattgcgtggaaaattcttcattttttattctccctctcctgattcttttccggtatcatatttttcaccgaatttttcttcccccatactttccagcatttccagaaaagcatccactacatgaggggcaaactgtgtcccttttccctttttcaattcctccacggccgcctgcagcgacagattgctgcggtaatgccggtgggaggtcatggcgtcaaaggaatcagccaccgcgataatcttggattcctccggtatttcatctcccttaagcccgtccggatatccccttccgtcaattctttcatgatggtgccgcacgatgggcaccacatcgttaaacagggtgatagcggaaagtatcttggcgcctttgtccgaatgtttctttatgttttcatattcctggtcatccagcttgtccggcttcatcagtattttgtctgagattcccaccttgccgatgtcatggaacaggccggccagccggactctgtccacaaacctcttatccttcttcatccattcggccagatccgccgccagatcggaaaccctgtctgaatggccccttgtataaatatctctctcatccacaacggtgcgcatcgcattaataatttccacatagctctcattcagctgctcataggccctggtaagctcttcgtttttggcgctgacaagccggtggagctggctgttatggatggccgaggatatctgcctggtatagatttccagcatctgtacctgcacatactcaggcccgggacacattgccgtgcccagaacccctatggcctcatgcttttcatcctctatggccgcgagcatgagatcctccgtacagatgactgtctgtccgtcaaaccggtttttttccacaatgcccggcacatcctccttacggatattcccaatcacatggatggctgcgtctccgttctcctgcatgccgggcatcataaggaaggctccttccccctggaatacatcctgggcgatccggagaatgctttcaaaaatggactgggtgttatccagatcatacagctgcggcagggattccatgatctgggacagcccgcttttataattctgtatgatccgcatctgggaaatggatttgacacaggattccaccagcagctccagctggtcaaaacggtcgcttttctcgtaatagccctgaatatccagttctctgatggttttgataggcggcgccatgcttttatggcccgtcagcaggatgatgtatatatccttatcaaatttgcggatttcctccaccacctgatcgccgcatatgggtgtcatcagaaaatccagaagcagtatgtcataatttccctcccgcacccgttttatggcgagataaggatcattgattacatccacatagtaaccggaacgctgaaaatatgcctgtaacgtggatgtcatgatgacgtcatcatctaacgtcaggattcggaaatccttatgcagcgtcctcctgttttttctcatcctcttttaatcccccttgttctttccggttttctcttcctgtacctcgctcagcggaatggaaacaccaacgatggcgccaccttccgggttatcctccacccacatattcccgccgaattttcctttgaccacagcatcggatatataaagccccaggcctgttccatgcgcgcctttattggtaaccatggccctgaacaagcgctccttcactcctgcgctgatgccggttcctgtatcctttacataaatcttcaggttatcctcatcctttttcacaccgatgacgatatctcctccgcccacctgcttctgggaataaatggcgttggaaagaagattgttcaatacctgcaccagattattgacatcaccgcggatggtataggtgcaattctcttccgtttccgttattaccctgctgccgctgctcatcagttcatgccgcatgagcagcatgcttctctttatcaactcttctgtagtaaatgttgcatcaacattggtattcacattggccgcctgtccttttatggccgtaatgatatccgacatataggaggaagattcccggaccttttcaaaccactgctccatttccttaaaaatttcccggtaatcgtcagcggtcacatcgggatcttccaggctgtccctgcattcctcaaccagattttccacagctgagatacaccccgatatactcattatgggtgttttcaggttatgggcaaggccgcctatcatctgtcccagggaagcaaggcgttcctgctccatcatcctggcctggctgtcctgaagctgctgcatgctcagcttcagctgggtcacatccttgaaaatcaccacaaaaccggacaggatttccttgatatacaaaggggttacatccaccacatagtaattcttccttgttccttcgccggtgtctatggttaccgcctgttcgtaggatatggtggaacacgcctccctgctggaggtcacggcggtaagcagattatatatggcagtttttttataaacatcctcttttttcacactgtcgcttaaataccggcttttcacgatgccatagcccgatgccagtattttttcaaagggcttgttatagctgataaccacccccttatcactgagtaccagatagcagtctgaaatccagtccagcacacgctgcatggctatgggcctgatatccagaatatggagctggtatatggcaatcccgttaagtatgatgggcaccatgaagctcagcggagtggccgtaatctggaagctgtttgtcacggtagccaaaacgctcacagtcagcgggcaaaggcagccaagggaaaacatcaggcactgcagcatataaagccggcttttattatgcagggcaaaatttatcatgaggatcaggctgacaagctggcacagccagctgtaaattccggcaatggcgatataagggccgaatacgatttcactttttattgtggaaaataccctgtagtgcagatgatgcaggggattggtccataccaccagaatcgtgatcacagggatcacaaacagccatatagtctttttcggcatttgctgccatcccttaacaaaaatcaatgcaatgcagagacaaaaaaccggcatcacggcacccatggtattggtacatgcgtcccagaacatgagcgccagtgtattatccctggaagtcagcttcattcccagtaatgcgatgacacacagaccgtaggatcccgccagcatgagataaaatttatggatcagctggagcctctttaccttgaagctccagatgaaaaataatatgattgcgatcagagccgctaaaaagatggcagcagaaaaatcggaaaccatttgccttcccccttctcacgtcttatgtaaacagccctgaaaacccttcgatcaggcgggcagccggagggattttccatccgaagccttcctttttaaatgtctccagggttttggagcagtccacctgtatcctgctttcaccgattcccgtccggttataataatccagaaggggagcgagtatatcccggttttcttcattcatccgttcctgcagcagcgtgccataggactcatccggcactatcacaagatcaggcacaagcgcctgcgctacctctttcatggatggcggctggggattcagcagatgcagcgccgtcctgtccgaaccgcccagagcgatcaccgcggcggcgcaccagtccacgggtgtcagatccacaggaagaagagacatggattccgttatggctccaagagcgcggaccgcccgcatcataagatatgcagcattgctctccggattccgctggaacacatgatccgtacaccgtcccgtgatccttcccagccggtataccctggcgttcagccctttttcttccatggccctgtaaatacaggcctccgcaaggaatttacttctgatatatatgttgtcttcccaattctggccgatataaaaatcgtcttccgtgaaaaccatttgtttttccggctcatccttcaggaaatcaccgctgatgctggccgtggatatatagtgaagcacagcatcggcctgcagggaaagtgcgatcatggtttccgtaccgatcacattcgtattcatgaattcccctgcatccgccgcataatgacgcacgtcagccgcactgtggtaaatcccgtcaatctcgtccgccagggccttccattcccgctcctccattcccagacagggcagggacaaatcgcccgccgccacccggatacggcttctgataccggctgtccagccggttccgaaataccaggaaagaacatcctcaagcctcttcttatctccgttcctgaccagacagatgatctgtgttttcccctgatccagaagctccttcagcagatgggccccgaaaaagccggtggcgcctgtgagaaatacggtgttttccttcttatgaattggccgcgctgccggtaccttcccgggataggccgtttttatttcttttttcttctctcctgcgccgcctgcgagcaaagccgcctgcgccctggccgtgggattttcgtaaaaccgggccatggtcatttccattccttcattaaaatacctgctcagcacgctgagcgctcccagggaggttcctccctgttcaaagaaggaaatatcaggagaaagatcttctctgcccaggattaccgaccagatccgaagaagcctgtcctccagcccgttccccgcagcattctgcgccgcctcaggccgcccgttttccggctgcaattttaccggcacgggtctttcctcactttcggctgttccttctttttcggtccacagcttcctgaggagccttacgtccaccttcccgttgggggtggcaggtaggctgtccacacggcagaaacgcccgggcaccatgacctccgtcaggctggaacgcagccattcccttatggtttcctctccatcttctccgccctcacccacataaaaggcgatcagctctgtagagccgtccggtttttccaacggaaccaccgccgcctgcgacgcggctccggattccaggatcccgtttatgatttcatccagctctacccgctggccgttgatttttacctggccgtcccttcttcccaggaattctatccggccatccgccctcaggcgtcccatatccccgctcttgtacattttctgttccgggaaatagatatccggaaaaaacatttccgccgtgagctccggccgtccgatatagccttcggagataccctctcccgccagataaagctctcccgccgccgtgggcatcaccggatttcgatcctcatcaagaatgtaaaccctgcagttggaaagagggacgccgatggtgatccgccttccctgaacgacctcttccacagtggtgcataccgccgcctcggtaggcccgtacatatttagcagcgtgcctgcacacacccttctgaagctttccgccaggctctccgtgagcgtttccccgccggcaatcacaagcttcaggcctgcagccgcctcccggaagctttcatttcccaggcacatctgcagccgggaggccgtcatctgtacaaactgtgcgccggtatcacgtataaggcctgccagcagccagggcagcatcatttcctcttcatccgccatcaccacgggattccccatggcgagtgggaaaagggattccacaataaaaatgtcaaacatcatattggcggtacaaagcaccggccccgttaccgaagccatcagcattttcatattggcgaacagattggacaggctgcggtgccggagcatgactcccttcggcctcccggtggatccggaagtaaacaggacatggatcaaatcctccccgtttattcccgtgtcttcccagggagcagccgtaagctcctccgaagaaagcaggggcagagcggtcttaccctgcatattcacccggttctccctgtcgcacagcaccattgacgcgccggccgtttccagaatataactcactcttttttccgggagagaaggggacagcggcacataggcacagccagccttcagaattcccagcattcctgccagaagccatggcgtacgggcaaagcagaggccgatccgatcccctcttgccgcgcctgcctcgtgcaggcctcccgctatggttcccgccatttgctccagttccctgtaagtcagcctttgtccatggtacatgaccgccgtttccccgggatacattctggcccggttcctcaccatctgatgcacgggctgattcagataaggcataaaacggtagttcgggatttcaaacagctccatccgatcggatacatccataagcggcagctcaccgattgtttccgctcccccgtccaccagcgccctgacgatgctctccatactcctgccataaagcctgacggtatcctcctcaaataaggatgaagcgtattcaaactgaagccggaactcttcttcctccagcaccagctcaataaacagctctgttttggctgttcccgtaaaaacgggcacgtactccatgggaatccccgccagctccagctttcccgtttcaaaaggacgcatggaaaaagcggcctgatacagcgggttgtccgaaaagcttctgggcagccccagcatggaaatcatttcctccagggaacagtccggatgctccagcataccggttacctcctgcctcacatcctgaagataacggagaggctccgtttccttatcgacggcaaggcggagcggcatggtattgataaagggaccgcagatttcctgcagctccctgtggtttcttcccgccgcaggcgtgcctatcatgatctcccgtttccctgaaaccgaagaaagcaggatcccgtaagcccccaggaacagcatgtagggggaaattccgttttcccggctccacctggtgcattcccgggttatttcggcagatatcctatgggtataattttttccctgaaaatcaaaattttttggcctgggcttgtctgtgggaagcagcagaggttccggaagaggcgacaaatgctccttccagtaccttctgtccgtttcccaatccgttttattccggttagacagggcataggcataatcctggtaccccagttcttcatattcctgtactcctccttcataataacggctcagacgcttcgcaaggatgggcgtactcattccgtccgcaatgatatggtgcacatcgatcaaaaggaaccagccttcctctccattctgccacagtccggcccgaagcaggggcgcttctcccagacagaagggcctgcggatctgttccatcacttcctcaagggaatttccctgcaaaaccggaagggaaaaaggaacctcaccgcggatacgggcaaatatcccgtcgtcctcctgcacaaaggctgtccggaaaatccgatcgcccgcaatcaccttacggaacgcctcctccagcttttccggttccacttcgccgcggatccggaaagcgccgggcatatgataggtaaagccctccgggtccatacaggactgtacataaatcccctgctggatgggcgtaagcggataacggtcaagctccggcgccgggcgcagcttctccttatgcctttcttcccttcccgtctcctgctccccgccgataaaacgggacagccgttccgcgctgcggcaggcatacagatcggaaatgcgcagcagccttcctgtaagatcctccagccgggccagaacctccatggcattcagggaattgcctccgcaaaggaaataatcattatcctttcccatctccggctgttccagaaccgtcctgaaaatctccagcacctgtccggtaagaatatcgtcggaggcggcggaaacctgcacatcctcccggggcaggggcagcctttcttcatccaccttgccgctgggcgtcagaggcagcctgtcaagccggataataaaggaagggagcatatattttggcagataagccgccgcataggaaagcagctccatctccggtatccccgtatcgctgcagtaataggcagccaggaccatctgtccgttcatctgacacacccttgcagccgcttccttcacaccgggataggaagaaatgcagtccgccacctcctgcggttcaatacgcagcccgcgcagcttcacctgtctgtccaggcggcctgccaggaggatttcaccctccggagtccaggccgccacatcccctgtggcataaatccgttctccggcttcaaaaggattctcaagaaagcttttttccgtcagttccggggcattccggtatcctctccccacgcagacgccgccgatgtacagctgcccgaaaacacccacaggctgtggattcatccattgatccagcacatacatccggcagttaggcatcggttttcccacagtgatggccgaagcatcgcccagctccttcatgctcaccgccacggtcgtttccgatggcccgtactgattataaatccgggcgcaggtacaatttttaagcagcttaagaagctctccggtaaaggcctccccgccgcagactatgctttccatccggtacatggcacggtaaaaagaaggctccttcagaaatgccgtgagcctggacggcgttatggacaggaagcccaccgcataccctgtgatcagctccgccagcctgcgcggggactcctgttcttcatcctccggcagaatgatggtccttgcattgagaagagcagccgtactttccagggtaaacgcatcgaagcctacattgcatacggaaagcaccgcccctttcccgtaaacagactccatcgctttcaccagattcaaaaggcttctctgcgtgatttccactccctttggctctccggtgcttcctgaggtatataccacataggcaagatcctccgatttggccctcgccggcgctttccccataccgtttccggtaagcctgtccatgatcaggaaccggatatcctccgcttcccggcccacctgtcctgccgtttcctcatcggtgatcagcacgcctgcgccgcttttttggtaaatggacaaaaccctttttaccggaagctccgtggacaaaagcagataggcattgcctgaccgcagcgttcccatcattgccgccagcagagggaactgcctcggaagaaggatggccgccacgcccttttcttccccgaaaaacggctccagcccgtcggaaacaacgcccgcccattcagcaagctgctcataggtcagcctttctccacggaaaatagccgcagcgcgctgcggatattcatttactgcctgttcaaatacctgatacagcccggtttcctctatataccggccggtattgttaaacgtataaaggaccttctcccgttcctctctgccgagcacagacagacggcacaggggcttgtccggattgtgcagggcctccatgagaatgtttaccagattttcatggaaacctgcaatttcctccctggtaaaaaactgggaaagataatcataatccacgcaatattgcttatggctttccatattgctcagatggatgcacagctgttccgcctgatagccgctgtagtgccatcttccgtcaaaaaccacacgggtgtccttattttcataaaccacactgtcctgataggacagcgcaatatggaacagtcttccatccttgtccgccagatccacgatatgggaaaatgggaatctctgatgacgcagaagctcataccaggcgtccatcaattcctcattgaactgattcagactccattcgtcctggatttcattataaaagggaagggtgttgacaaacattccgctgcactgcttcagcgtatagctggaacggttaaaaacaggcacgcccaccgtaaagcgggaagcgcctccgatacgccggaaatagatggcaagagccatataaaagacagcaaaaggggcaactctgttgttcagacaatacagatagatagcatgattgagcacctgcggaagccggaagctcatcctttgtcccacaggactgaccgcggcactcttcacggatttgatgacggaaggctcccccgctttttccacttccgccctccaataccgctcatccttccgataagcctttcccgccagatactcctcttcctcctgaagatgcagctcataggaagggatttctcccatggaaggctcctctcctgcaagcagggcaaggtatgtccggctgatcctgttgcagaccagcatctgagtccagccgtcagatataatatggtgaagtttgataaaaaaaccaccggcgctttcgccggtgcggaaaagggaaaaacgatacaggggagcatccagaaccggaaacacctccctgctcatcgccgtctcccaactggcgattccctcctgatctgtatgggaaaaatcatagatgtcaaaagtctgttctttataaggggcaaaaaactgcacaggcttatctccctgcagcgtaatccgggtccgcagggtcgcatcggcttccagaagcatggtgatactcctctgtaaaagcacaaaatcaattttaccacggatagtaaccgttgtgctgatatgattgattgatgttcccggataagcctgttccagattccagatattcaactgactctgggacagaggaaatactgttatccctccaaaatccattatttcttcccgccctttcaactagccgctctgttgcctttccttaccggaagacatttttcatacattatatttataccgttttttatgcataaaagcaatgcaattcgctattctgtagtataaagcactaaattataaaaaagaagaacgtttttatacagcagtccgttgaaaggcgggagcgcaacacatttttcggcttcttacagagggatgtttccatgctttttcttaggcgcctcttcctttttcccgcggaatgctttcagcgccgcaagcagtttttctctggactcctcgggtttgatcacttcatccacaaaacctctggcagcggcaacataaggattgaggaagcgttcctcatattcctggatgcactgggcgcgcatggcctccggatcgggagctgccttgatttttctcttgaatgctatattcacggctccttccgcacccataaccgcaatttccgcgatgggccatgcatacacataatcggctcccatttccctggaattcatggcgatatacgccccgccgtaagccttgcgcataatcagggaaatcttgggaacggttgcctccgaataggcatacagcaccttggccccgtggcggatgattccgctgtgctcctgggctgttcccggcaggaaggcagggacatccaccaatgtcaggataggcaggccgaagcaatcgcagaaccggataaaacgggccattttgtcagatgcatgataatccagggaaccgcccataaccgcgggctggttcgccacgaagcctacggtttccccgtccatacgtgcaaatccgaccaccacattcccggcaaaatcctgctgtacctcaaaaaagcttcctttatccgcaatccggctgatgacatccttcacgtcataggaacgcctggaattatccggcacaatgctctgcagatccgcgcatgggttatcaccgcttttcttgctgctgtgtattttccgtcccaggctgcccacatgctccagtaccttgttaacgttgcgggaaagcgcttttttttcttccagtctgatgaccggcgctttttcccggaaattggaagggagataattcaggagtttgcgcacgcccatcaggcattccccttcggtatcataagtgaaatgggaaacaccgctttttttcgcatggacctcggcaccgcccagctcttccacggtggtcacttcattgataaccgttttcaccacattagggccggttatgaacatcttggaggtatccttcaccatgaaaatgaaatcacagatggcgggcgcataacaggcgccgccggagcaggggcccagaatcaccgcgatctggggaatcacgccggaagccttggtatggcgcaggaacattcccgcgtagccgcttaaggaactgattccctcctcgatcctggctccgccgctgtcattcacacatacaagaggggctttcatttccatggccatatcctgaagacggcagatcttcatggaatgatattctccgagagtgccgccgataaccgtaaagtcctcgctggcggcaaacaccagccttccgtccacataaccgtagcccgttaccacgccgtctcccggcactcttctcttatccagatcaaaatcatcgattctggactcaatgaaggcatcggtttccacaaaggttcccttgtcaaataaaagatcaagcctctcccttgccgtcagttttccgcccgcatgctgcttgtctatttttgactgtccgcctcctaaaagggctttctgtcttctttcgtccagatttttattcgcctgttcccaattcatatgtggaatcctcctgaatgactcgtttttctaactatttgaaattataataatttgatattcaaattatttaagcattattatagcacggctgagaaaaagtgcaatctttttttcagccgtgccataatttcatccgaaaatcaaatcgggatatttcccttacaggtctcttggccagggaaaggaggaaggatcatatacttctccccggttcagctggggatatctggtagcatggcggctgaagccgctgccccaatagctgacctccccgtcaaattccaggcagatcatcgtgattcccagcagctcgtcctcttccttatccggcagctccttcagggtgatgcggtattcatcctgttcaaacgcgatgggtgtgccgcttgccagaaaataagctttttccagcttattctggattcccgcaatataaatggtatgatcctgctccggccagaagaaattccatacatgggctttgtttccttcaaaggtcacattggagctgccatgatagatgatctgtttggcgtcctttcggccgtacaggaagccgtggtttttctcaatccatttccccaccttctgcaaaggctccacagcctcctcgggaatgcttccgtccgccctcggccctatattcagaagcaggtttccgccttccttggtcacttcataaagcattctggcaatctgctgggccgaatggctgtagggacgcacccgcctggaatccaggtacccccagcttatgccgttaaaggtcatgcaggcctcccaatcccttccggcagggacaatctttccctccggcgtctggaaatcttcatccagcctgctgcggttattgatgataatatcgggctggagggaacgcaccatctggttcagctccagggaattccagccttcgtgggattccatcggctggggcacatcgtaccagagcacatcaattttcccataattggtcatcagttcccggttcagctccataatatatttattaaaacggattctggcctgggaatcataggcgcatctgccgctgtccgggtgcttccattccatcagggtggagtagaagcccaccttcaggccgaattcccggcaggcatccacaaattcccgcacaatatcccttttcgggccgtaattcatgctgttaaagggattcacttgggaatcccaaaggctgaagccctcatgatgccttgtcgtaagcaccatgtacttcatccccgcgctctttgccagcctggcccactccctgcagcagccctctttggccagaaagccgtccgcaaatttggcatattcctcgggcggccagttttccatcgccatcgcccattcatgttttccgtataccgaataaaggcccagatggacaaacataccgaatctggcatccctccaccatctcattctctcatctctggtggcggaaacctgcctctcatattccgccttgctgattgctcccattttattctcctctcttcttcctcttttcctgctaaatcagccctttactgcgcctatcataacgccttgtacaaaatacttctgcacaaaaggatatatcaacagcatcggtaccgacgccaccacaattacggaatacttcagcagatccgtcaggcctctggctgcctccgccgccgagacatcgctcagcatagtaggatccaccacgctgtttatcaatatttcacgcaggaacagcgtcaatggccataaattctgatccttcaggtacaccattgcattaaaatatgcattccagtgtcccactccgtaatacaggacaagcactgcgaggatgggtttggagagctgaaccactaccttgaccaggtaaccgaagggcgaacagccgtccagagaagccgcctcataaagctcatccggtatggaatttaccatataggtcctgcacaggatcatattccaggggcttaacgccacaggcagaagaagggcccatctggtgttgagaatccccagattttttacaagaaggtaggtaggaatcaatccgccgctgaagtacatggtaaaaacaacaagagcggatatcacatttctggctgtaaattcttttctggaaagaggatacgcacaggccaccgttaccacaatatttattgtcgttcccacgataacataaaaaaaggaattcaaaaaaccggtccagattttagggtttttaaacactgcctggtaacctttgagcgtaggatttacaggccatatccaaaccttcccgtttaccaccgcgctgggatcggagaaggatgcgctgacgacatacatcagcgggaaaataacgatcagacacacaaatatcagcagtgcgtaatcacagataataaaaattttgtcttttgttcccgctgttttaaaagaacccattttattcataatccactcctcctaaaacaaactggtatcggtaagctttttcgatatctgattcacaaaaaccagaagcacaaagctgaccaccgaattaaaaagacctgccgccgttgcaaaggaataattcccgttggataagcccaccttgtacacgaatgtggcaatcaattccgatttgggaagattcacgctgttctgcatcagataaaccttctcaaatccaatgttgataatattcccgcagttgaaaataaacatggttacgatagtagggaagatagcagggatatccacatgcctgatccgctgcattcttgatgcgccgtcacagatagccgcctctttcagctccggacttactccggccagggaggcaatataaataactgccgaatatcccatggtctgccaaatcccgctgcctacaaataaccctctgaacatatccttgtcaccgaaaaagttaatcggggcaatgccgaatataccgataatccggttcatgattccggttctcatatccgttacctgcataaggataccgaccagaataactgtagatataaaatagggcgcataagttatcatctgtacaaattttttaaatcgcacccggcggcactcatttaatgcaattgccagaataataggaatgggaaacgtgaaaacaagctggtaaaaaccgagtataaatgtgttgcgtataaccttaacgctggaaggtgacgtcagaaactgcataatatatttcaatccgacccaatcacttcccataattccttttcttggactgtaatccttaaaggcaatgactattcccagcatggggagatagttaaacaccataatgataatcaggggaattaaaatgatcgcccaaaactgccatgtggatccttttacttttttcttttttactgctgctgccatggccactcctttccgaacaacagggaagggggcagccgccccctaacctcttacctgtctattacctgctgatacacatcaagaatctgctgtaatccaaggctgtcaagctgacttacataagaatcccagtccttgtcaatatccatctttcctgtgataaaagcaacctggctttctttgatataattgctcacctctaccagaggaactgctacctcatcctgttcttccggcgtcagatgcatgataggaaggatgttataatcgcctttcttcggagcataaggctccattttctctttggtttcctcataaaggaatttttccagggctgtgggatcgtatttatccagatccgccgccgctgattccccgagacgtacgtcggaggggccatagaaaaggctcgtcacctgccagtcgtgattctgcacgtccgttgtgtagccattcaggagtgtatacatggcaggctttccgttaacgccaacctctccttccggttcccagatataatccacgccttcttccgtaccgtactgggccataacataactcttaggctgatagaaccagtcaataaagcgtaaagcgacttcgggattttcacatttatcggtaatgacaaaacggttctcatataaaccatcgttataataataaggagttacccgtaccccttccggcccttcaacaggagacagggcctcataatgacgatacatttcattgcttgcagtagaatctatatatttggcggaatacagatgggggaagaacaataccggttctccatcctgattaatcagggaacgcaggccgtcttccgtattggaaaagtttccttcataaaatgcgcccatatcataaagactcttgatatatttaagcccttccttaaactgaggctgtgtggctgcagaaatcacctttccgtcaggagatacaatacacttggcggaattggtcttatcatgggaaccatgcggatcatccggtgtgaggataaaggcgttcatgagccagttaatcgccgcattgtcattcatatcgcctatagccaccccattgggatttttctcaagataagccttacatacgtcatagaattcctgtgtagttgtcggtacgcttaatcccatttcgttcagcttgtaggaattcatccacatcttgtttccatacattacatgataggcttcattaatagaaggcagtccgtagatttttccatcactctgcctgatggaatccagggtataagaagcatttgccatgaagttaggcatgttcttttcaattaaatcatccagcggaataagcattccctctttcacgccgtattttacaacatcaggctccagtgtcataaatacgtcaggataatcaccgccggccatcgccaggtttatcttttcctgggaatcctcatagcttaccgcttcgatttccaaattgattcccgttaagtcttccatatactttgtgaaatcgttggtattataatcttcaatataaggctttgacataatcattatcttcagggttaccggttccgtaacaatgggataggttccgggctctgtcagcagggaatcccccgtgttctctgccacactttccttcccggcatcctctgccgcctggcttcctttatccgctgccggactgtccttcgcgccgcaggcactgagacctattaccaatgttgtacagcagacagccgccatcaatttcttccacaacttattcattctttttcctcctagtataataatggtgtagtcaagaacgactactaagttaaaagttacaaagtccaatctaatcaatctatatagatataacggaaggaggagttctccctccatcagaagttataaggcaaccttatttaccttgcctgaggtttccttcatgcaccagacaaaagatagaggtataatcacggaaggcaggattatggacgtttcctccttgggaaccggccttttggctggtgaaacctctaaaaaagtctgtcagtccattcggtggtgatttatgttttggctggttgggatgccccaggctatacctgtataacccgctaggttgtgtatccaccttctggaattggatacctgccagaaaggatcaagttatgcactatcaaaaagttctcaagatgctggaaagcatcccctatctctctgtagggcttgatgtcggcgctgatttcacctggatgtccatcatgctcccaaatggcctcctcactggaaaaccctttaagatcatccactccgatccgcagtcccgtgagcttgctgtcacaaaaataaaggaagcacaagagacgtattctctcaaaagccgctgcttccttgagtccaccgggatctatcacatcccgctcctgtgcttccttcgtgataaggggtttgactgctccgtcattaatcctatcatcactaagaatagcacaaatatgaacgtaaggaaactgcataatgacaaatttgattcaaaaaaagcggctagagttggactggatgcttccctaaagacttccatcgttccggacgatgagatcatcgacctacggaacctggtccgtgattactattacttcaaagacctacagtcggcggtcgttctcaaactacatgcagaactgaaagtttccttccccgcttacctacaggtgttcagtaagatcaccacgcagacttccttaaaccttctatatgcataccctcttgccagggacatgcttgccgctccaaaggatgacatcatcaaaaccatccggagcacagcacgctttggggaaatgtatgcccttgccaggtatgacgccttatacactgccgcgaaagattccgaattgttcgggcgcgcccttcccagcaatgccctccggattaggctgtacatagattcttaccgggaataccaggggcatctggactccattctgcaagaactgcacaaggctgtagatagacttcaggggaatcctgcatataaccgcatccgtctcctacagtccctgcgcggcatcggctttttaagcgctgttgtcctaatcgcagaaatgggttcctttgacttatttccttcacccaagaagctctatgcttactttgggttggatcccggtgtaaatgattccggcaagctcaggggagacagggtccacatgtccaagcgggggtccggtcttgcgcgtcgtatcctgcatatgattgccataaacaacttaaaaatggagaaagggataaaaacacctgtaaacccggttatttatgactattacacccgcaaatgtgccagcaagaaaaagagggttgctgtcggagccgttatgcataaaatctgcaacatcattttcgctatgctgcgggataacaaaccttttgagatcattacacccgaagagcattgtaaacgctatgtgacagaacagtctgccaaaacagaaacagcagcttaaagatccaccactatgaaatttttaaattcccatatccgatgggtttattaaagtcgcctttttttacaccaactgctcaaaaaaactttttaaacatttttcactttatttcttgacatttcttagctggactttttcccttccttttactttttttcttctgtttatgtactaatgataacccatacttttttcatatgtcaattataatgcctgttttttgaacccatttttatgtgcatactgtacataaaatatatttatatcgcaagctatttttgtttattttccacatatgcctgcacattattgaggtgttccaaccagccgtttgtgcattttcataaccccatttccataatatggattccgccccttttcaccggcttttttccttaatacctgcatgcaaaacaccccggccaaaaatcttccgtcaggccgtatttcataaatatttttgccgcatattcgctgtaacatgccatcccttcatcatttggatgaaggatcccgtccgccagggcatcctctttgtgaggtgccgcaagatacccgtcaatggtttctattcccctctctttggccgcattaagcaaagcgaggcagaacggcctgaactctccggctttcgtgggtacgcccgtgtctcccctccacagcggagagaagtaaaagatcggacggccgggatacaattccatgattttatcaaaatacctttctgcattccggacagcctcttccttcgattccgcccaattccagtcgttggttccgaacgccaccgtcactatatcaggctggaagggaagcttttcatccagcaggccggcatcgaaaatataaccgctcaggcccgcattccacagctcccagtcaaaatagcgggccaggcgcaccgcatagccctgggacggatgaagggcatcatatccctgggtgatggaatccccgtagcataaaagctttttacggatccttcccgggaaatccccgtcaggcgtcccctcctccagcgtgcatagggaagcgccgggcgcaaggcttatattttttagggctatgctgctcatataagggaaccataccgtaatgcggttccagcggtggccgtccctgtcaatcctatgacggatactgccgactgtatcctttcccggtttctgtgcagggcctcctgttctgacgccgttctggcagatatccagctggacgatatccctgtccgccatcccggaaatctcataatcaaattccaggctgccgctgtccgtgtagaaatccatgcagattccggcggtacaccccatccgtaccaggaaacgcgcatcctcctcccttgtaaaatatccatactgtttttccgtcattctggaaaaggagaaggcccctgtttccttctcccttacaagtcccccatagactattttcttcatatcctctaatccgaacattgccagcctcccattcactcctatttatttccggccgcttccatatctccccgcattccgtaaagaaatacatctgaaaaacgaatgcggagggtatagattttcccttcctccggaatagttccatcccataaaacggtttcccagcggggttctccggaaccggcattcccctccggctcagttcccgtatcctccgttttccctgtaaggcatattcttcccttctcatctgtcagctccgccaaaatactgcctgaacgccctctttccgtaagaagctctaatctgctgctcctgaaaaagaagggattggcagaaagcaccgcctcccgcatgggatccttctgcctgtaatacgcgaaacagtcttttgggatatatcctctggagaaggatgtttcgcggtagtccgtatgccgcccgttccctcccatataataaaaatagagcctgtcaccgatgggaaccggcgcgctggaatagatacatccgcagtcaaattccccatcaggataggttccctttccccgatccataaaattttctccgaaggccacttcttcccagtccaatgtatcgacagaccaggccagccgcaaatccaccgtatcataatccttatccgccgtatccccttcatggtaaacggaagggactcccagataaatatcgttataacggaaaaccggcatggaatatatctgatcctcaaatccccgtccgcggaatatttcctgcggctccgtccagttcaggaaatctgagctctcacatcttgccgcgatacgctgcccgtttttccatatccgtgtaatcagcacaaatcttcctgtccgttcctcccggaacacaaaattatgcgtatccgcccggggctggccgcctgtccattttttcagttccccgaaatgaatgccgtcggcggagaagccaacggccatataaccgcacccgggggcataatccaccttggtcaccagcttatagcgccggttcggatccggctcttcctcatccagaaaaacgccggttccatggacataggcatacaggatattgttccgtttgtttcccttaaaatccaccagccccagttccggcttttcccagtggattccgtctgtggaacaggcgtagcacagggccgtcacacgatcggagccggggacataggttttcgccgcccgctccttcagcggcgtattctcgctgtccctgtcatggatgaacaaggtataatagcaccggtatatcttctctttgctgtcatacaacacattgggatatccgttatcatagcgcacctcccactttctgggcggatcagcaaagaaatcttccctgaaaaaaacagttccctctttttgtatggacgccagctccacttttgcattggtcatatatctgccgttaaatattcccctgtccagaaacaaatattttttcatgcctcccacacttccttcaattgataaactgatgccttataaactgtgaactccagcatataatcacccgggaccgccggggacttttgtcccttccatgtgagcatccattccccgtttttctccgaagacccgtcaaaatcctgaaaatcgaagcctgccgtcactttcccgtctgccgcaaggactctgcagcaaatatatccgtccctctccctttcggaatccagcagcagcttttgtcccttcagcggtatgggcaaggtgatcagacgacccggcctctccctatccttcggcgtcattcctgccagacgggatttcttcagactcgccagctgcagggatgcctttttaaagccggtatgttttccgtttccccctgtgtaataaaaaaggaactcctcttcatgctccaccggggccgcgcagtaaatgcagccgtcatcgtatgcatcctttccgctgcccaatggaaggaagctctcatggggaacaatccggctgaagctctctctgtccgcgccatagaccaattcgcattccaccttatcgtaaagcggggaatccatgtcccctccatgatagatggaaacgagcccgaaccagagtccggcataagagaacacgggcatggagtaggactgatcctccggggtgtcccctctgaaaatctgtttcgctccggaccagtgaatgaaatcccggctggagcaggccatcaccaggcggtttttattgctgaaggccctggttgtcaggaagtattctcctttttcggcatcaaaggaacagaaattatgggtatcgccgataattctctcttcgattcccgccgggatataatcaccgaaccgaaggccatcctccgaaaatgccacgcacattccgacgggatttctgtcatccctggtaaacagcttgtacctcctgtccgcccgctcttcgctgtaatcataaaacacactgcttccgtgggcatacaggcggagcagattattctccctgccgccccggaactccacaaggccgagcgccgggcgttcccagtgcaggccgtcttcggattccgcataggcaagcgccgtaatcaggccggagccgggctttgttttcgttccggctttttcctcttccgtctccagcaggaccgtataataacaccggtaccggagcaggacgggatcccggaatatgttgggatagctgcagtaaatctgatatttccacgggtcattctgtggaataaaccctgtttccttcctgctgtcgttcctaaaaagaggattttgagccgccttttccggctttcccaaaaccggttccatatttccatagctctttataaatcccgaatcaaataacaagtggagcttttcttccatatttcctcctcacaaatttttattctttcaaatcagctgcagggtatgcagagcctccgcgattccgtcctcccaggagcagggacttacataatcggcggcctgctgcagttcctttttcccatttcccatcgccacgcctatggccgcctgggttatcatctccacatcgttcccgctgtccccgaaggctatgatattttccggcccgagccccagccctttgagaagccgtttcagccccgccattttgtggacaccttcccgcattacgtcaataccgtgggcatccttaaattcatccaccgcaaaaaatttctgtatttcctgtttcagttccccgtccccatatatgctgattcctatcggcagcttccggttatgggtcttatgtttttcatcaaagtaggtctgtccctccaccataccaggccccacatcccacagctttcttcccgcttcataatcgaaataaatgcagttttcattctggtattttaaaatcatggcccctccgtaagcgtttgtcaggtccaccagaaaatccgtttcttttctggaaaaggggttcgaaaaaaatatcaggctgtttctgtcggacaccagcgccccattggacagaatataataatccggagccaattcctctgtaatctgcggattcagcatggccatcgtcctgcccgtggcaacaatgataaaataacccttttccttcagacgtgccaccgcgtctatcgccgaatgggggacacagccgttcctgtaatcatacagcgtaccatccacatcaaaaaccgcggctttaatatccttatccacgcatagcatactcatacacagcaccttccttttccatttttcatctcccgttttttgagagaaggaaagtcagtatactaccgcagcctcctgcgtgcaagtatttttttcaatgtattgccataaaatgaaaaaaagccccaagcatgcctgcctggttcccgttctgcgcaaatgcgatcctggttttctcccggactgccggcagaagatgctttttaaggccggcctgtatgcggggaagaagatattccttcctggacatgatacctcctcccaggaccacgatctccggattcagtacatagcagatattggcgatccctgtcccgaggacatccgtcatctcatcaattgcccgtatacagcagccgtctcccgcttccgcctgttcaaaaacccatttcccgtctatatcggcagcagccagccctttttctccggccacccgggaaagcagagcgccggcggatcccagatcctggaacatcccgccgggaatattcatatatcccacctcgcaggcgcttcccgaaaagccatgataaacccggtcatgaaacagaatggcgcccccgataccggtcccgatggtcaggcatacggcagaagcgcatccttttgccgctccggcaagacactctgccagccctgcgcagtttacgtcattttccacctcacagggaaggccgaacctctcttccatcctttttttcaatccggttcccgcataatccggtatctgagggcctgaaaaagtaatttcccctttttcgcagtccaccatgccggcggtggaaatgcagattcccgacagacggtgcctccttccggcctcttcgcagatccgctccagtttttccagaatgcccggcccgcccttccaggcctctgtcgggatttcgccagtctccaggaatttaccttcctcctgcacaaccccgtacttcattgcagttcccccgatatctacacacacatattctttcattccgcctcctgccgcagcctgaccttaataaccgcctttcggacatattccggctttcctgtacttattttgggcatatgggcatcctccggaaagcatatggcaaaatccccctcccccatcagaaatctcaccttcggctttcccgtatacagacagcagtcgccctccctgctgtaagcctccttcacctgaagctcctccgcaggggcgcagcacagatattcacatccgtccgccgcgatatggatatccagataatccctgtgcccctcaaaaatttccccctccggctccgtccaataatcaaaccggttcatataaacttcatcgccgtcaatcgggtagctgccggcctcaaaatccatggggttattctcctccagaaaacggattgccttatccaggttagcgtacagcccggcatatcttcctatattttttaattttccaagtatcatatcagattcctcttctttttattcctgcgccatcgcaagcttatcaatctcttccgtaaaggttcttgttatcacctgcggccttgtaataatagatcccaccaccacgctgtagcagccgatttccagaactcttctcgccttctgcggggtattgatgtttccttccgcaatcacgggatgatttactttttccagtatctgccttatgatttcaaagtcattttcttctatctgctttccagcgctctgctccgtatagcctacaagggtggttcccagaaaatcaaagcccagccgatccgcatgcagcacctcctccacggtggagcagtcagccatcagaggctgtccgggatatctgtttctgatttcctccacgaaatcatccagcaggacgccgcccggccgcctggatccggtggcatccagggctataatatcagctcccgcctccaccagggcatccacttcccgcattgtgggagttatgtaaaccggactgtccgcatactctttttttacaattcctattatgggaagctccacatttcttttaatttcttcaatatcttccctgctgttagcccggataccacaggcgcctccttcctttgcagcctttgccattcttcccatgataaaggaagagtgcagcggctcatccggaagtgcctgacaggatacaataagcttcttatatatctgacttattttctctgacatgttatcccctttcttctcacatccacctgattacggacggcttttgcaacgatccttcttttaccgaaggattccataggtttattatattaatttcaggtttttattacaattcactgcgttcctttagaaatttcaattcaaatattttacgttatgtctttttaagccttcattttttaagtatttttagtaattttgtacattttatgttttttcaatccgcacccgccgccttttttattttgtatccgggcacaaaaaaagctgcccggatttctccggaacagcagttttaatcagccataaccgactgcagctattcttgttaaaacacgattctgtcattcggctcctctgcctggatcgccgaaagcgtatcctgcagcaatgccgtcttgtagttggaatccattcccatataacagctgtagatgatatctgtcaatatgagcagcggaaactggggagagatattatcccccagggacaggccctcaatggacggtataatcagcacatgccggaacagctcctgaagctgttttctgcggttggatgtgatcaaagtcacacccacattgcgcagctttgccgccttcagcgctcccagcacctctctcgtctcgccgctcaggctcatgccgatcaccagatcctccggccttgcaagaaccgcctgcatctgcatcaggtggggattatcgatcacctccacctggaggccgagcctcataaaacgcagcttgaactctgatgccgcgcaggcggagcttcccaatgcgaaaataaaaacccgttccgccttggacagcgactgacagaaagcatttattttatccatctcaagctttccgttaaatccctggagaagcttctgatacgtatcaaggattttctgcaccacatcatcattggtatatttgggcatatgaaaatttatttcatacatatactgaaattcccggtagccggaaaagcctattttcttggcaaaccgggacagggcggtttcagagacatgcagctgcctgcttaagatttttgccgaaaaatcctgttttttctggttgtccagaaagaaacgcgcaatcagcttctccgtatccgtcatttcctgatagtggaggcgtatcctttccaggatatcctgataataaatattcatagctcttccgccaccatatcaagggccgccctcagaaccttatccatgtcataatagcggtactgccccagccttcccccaaaaagcacattcttttcctgctgtgccaattcccggtatccggcatacagcgccatgtttttgtcatcattcacgggataataaggctcatcccccggtttccattccgcaggatattcctttgtgatcacagtcccatgctgtgtcccgaattcgaagtgcttgtgttcgataattctcgtatagggaacggcttcgtcggtataattcactaccgcattcccctggaaattatcctcgtcaggaagctcctccgtctcaaaacggagggaacggtattccagcgctcccagacggaaatcaaaatactcatcgatcattccggtatacaatactttatcccatgtatccggagactgcttttccctgttatccctcagaaactccctgtagcttatgccggtgcgtacttcggtaccctccagcattttggccgctattgccgtatagccgccttttggaatcccctgatagggatcattgaaataattattatcgtatcggaaccgaaggggaacgcgcttaatgataaaagcaggcagctccctgcagtcccttccccactgtttctgggtatatcctttgatcaatttctcgtatacgtctttgcctgccagggaaagcgcctgttcttccagattgcggggttccccgatattcaggctggctatctggccggcaattattttctgtgcttccgccggtgtgcggattccccacattttactgaaggtgttcatattaaagggcaggttataaagctcgtccttatacaccgcaatgggtgaattgatatagttgttaaactctgcgaactgccctatatagtcccatatttccttgtcggaggtatgaaaaatatgggcaccgtacttatgtacctggatgcccatactctcttccgtgtagatatttccggcaatatggtctcttttgtcaatcagcaggcagcgtttaccgcgtccgtacatctcgtgtgcaaaacaggctccgaaaagcccggctcccacaatcagataatcataatgcatggaatctctccttcattattttgctttgtatttcttaatctgtacaaagtcgtccatcagtccaaggatcttgtccctgccttcctggttcagctttacgtaatactgcattacgcggttttcgagaagctgctcgctgatggtagtgtctctttccagagaactgaagtctaccggattcaggttaagcttgttgcacattttgataacggtaccgtaggccatcccatcaatgcctctttccagtgccgtcaccagtgtgctgtaagggatctgcatttctaatgcaaattgccttacgcttctgtactggcttaaaatttcttttttcaagatctgtgctttggtcatttcaaatccctccattaccttttaaccctaaggttttgcattgttaattgtacactatttacctttcattttgcaacatttcttttaaaaaacaaacaaaatttcgaatattttaagaaattggtcataatatactataaaattgccataacagctaaaaaactgtcagttgctgtaatttagcgaagattaaaataatttttccaccacggaccgggaggtaatttcgttgttccgcttgcattcttcgaaatttctttcgtaatattcctggtatagcatgtccacaagatagagctggctcattttagccttcatggatccgccttccagcggggcttcgttggatccgcacagaagtaccgcatcgcagtattccgtcagcggggacttgcggaaatgagtgatacatacaatctttgcccctgcctctttggcaagcttcgccacatggatattatccttggtagcgcctgaataggaaataataatgattaggtcatcctgtgtacaaagggacgccgccatggactgcatatgaggatcggtaatgcagctgaccttgttcgtcaggcgcaggaatttgttcctggcctcctccgctgtcagaaggctgtctcctattccgaaaaaatggatgcgtccggctgcttcaaacatggaaatcaccttactgaaggtttctctctccagcagcatataggtttctctgatggcgcttatatgctgttccatgattctctgcgccatggctccgaagctgtcctcccggcctctcccggcttcggttccgaagccttccgaagccgcctggcttaaggacagcttcattttgaattcctgatatccctgcagcttcatggtccggcagaagcggtatacgctggcatctcccacttcacaggcatccgccaaatccgtaatggacatgtacaggaccttctcctgattatccagcacataatccgcaaccttcttttcggccttggtaaactgattgtatgatgccttgatttgcagaacgaaattatccttactcaatttttctgtctcctctttcttctccttatgctacaccggaaaatagcttttggcaactttttttattatttttaaaattatgaaaatatttttcattttttcttgtctgttcctatataaaatgatatgattttgtcagaacaaagtcaatcttttgcattggaaggaaaagagggaaaaaacatgtcaaaatatgatgtatcgcgattccgcaatgtaaccgtggcactcaatactccttttgccccgaatggcgatgtggatctggccgctgccagaaaactcacgcgctattatatcgaaaagggagtcaggagtctttatgtatgcggcagcacaggggaagggttcctgctggacagccgggagaggatgtccgtggcggaggctgtaaaggaagaagcgggcgatgccatgaccattattgtccatgtgggctgcccggatacgaaacattctgcggagctggcccgccatgcggaaaaagccggcgcagacgctacaagcgcagttcccagcgtctattaccggctgggtgaagaaagtgtataccgccattggacggccatcaccgaggcggcggatctgccgttttttatttacaacattcctcagctcacgggctttaacctttccatgggattattcggacgtatgcttgccaacgagagggtagccggagtaaaatgttcttcagagccctgtcacgatatcctccggttcaagcaggcgggcggcgaagacttcatcgttttcagcggttccgacgaacagtacctggccggccgtcttatgggggctgacgcaggcatcggagggacctacggagccatgccggagctgtatctgaagctggatgagctgattggccgggaagagattaaaaaggcgcagaagctgcagatcatggtgactgattttatataccgcctgtgctccttcccttccatgtatggcgcatgcaagactatcatccgcatggacggcgtggacatcggggaaccccggcttccattccttcccgtggacgaaaaggatcctgccatcatacagctttataaggatatccgcagcgcggtggaagaaaccagaaactggtaagacaatctatttcaggagaataagtcagaatgaaaaaaacaattgtagctttcggagattccaatacacatgggtactgttcggaaacatgcggacgtttcagcgaggaggaacgctggccctgccttctggaaaagtatctgggtgaagaataccgtgttatggaggaagggctgagcggacggaccactgtctttgaggatcctctgtttgaaggcttaagcggtctgtcttacatttttccctgtctgatgacccatgagccggtggatctcctgatcatcatgctggggacgaatgataccaaagcccgtttttcctgtaacggcgagaacatttccaaaggcctggaacgccttgtgaataaggccctttccataaaagatgcctggaggaacggccccaggatcctgattgtggctccggcgcccattgaggaaggctgcctctccgcccctgttgtgggagagatggggcccgactgtgtggaaaagtcccgggaactggccttctggtttgaggatgtcgccgcacgcacaggctgcagctttctggatgccggaagcattccgggaatccgtatgcatccgaatgattacatgcatctggacagggaaagccatacgcttcttgcacgggcgcttgcggaacggattccttcccttttttagggaccgatcattccatacgcgttcaaatgaggtatttcccaaaatgggggagggatcaaaaaagaggccgtcggcctcttttttgtatatctgtttattgaagcaactcttccggcctcagccccatacacggaaacggttaaacccttccttcagatccgcaaacgctccggccgcgctgccggcttctctggtatttcccagatagtccgtatccagcacgacagggtttccgtcgggatcatcgaaaggcgcttccacaaggcgcaccattcccagcttctgtgtatcaatcacttccgtgggcatggaaagcatttctttttccacattcatttccagatatacggcatctccttcagacactatcttcacctgaggatccgcctggctgatataattttctttttcccggtcaaaggccccggcccccttcaggtaagcgtttccatttatgtaaaccggctgctttaccttctcaaacatctccacatcaccgtttccgagagccgtaacttcttgcacatattcctccagagaggtacagcttccgttatagtcggtggttcccgccacagactgctctgtgtaggtctccgcaccgccgatgaaaatgttctggtaaatacgatcatccccgccgtaaacgagcgtggttccggccacctgtgtggtgtgggggaaatgatagggagtggagcggttgagtacaggctccctgcgcatggtgccgcagcagaggttgttcacataagcgccgccctgggcgatgttgtcaaaattgtattcggagccgaagatattattgtccaccatataagggccgtgggtcacttccaccatcaaatccctgtcgttggcatagaacaggttgctgctcaccctggttccctgcgcctgccagtcaagccaggttcccagcgtgcagttatggatatggttatgggaaatctccgcatcgatggcggcatgcagcttgattccggcgatttcatagccgaaatattcatgcttgacggcaatattataaatatggttattcgtgatctgactgaaaacgcagcccatatggcctaccacaccgttctgtccgcagtcatggatcacgttgttgcggatgatatgggaaccgattttttccttgctccagccaatctgaagggcgcggaatactgcttccatctgatactgatagcccggcttgcggtgtcttctcgtgcacaggttatgtcctgtggaggcttccttgccgatgcttatgccgctgcacttcgcatcatgtatttcattattttcaatgatccatcccttgctccagtgcgttcccagaaggccgggctgatcggcggtgggaggcgtccagggacatgcggcctgggccatttcaaagccgcgcacggtaatatagttcattcccggcttttcgggatagaaacagcacttgcgcacattgatttcggccagctcctcattgggatcggcgccctggaaattggcataaatgatggtattttcttcctccacgcaggcataccactggtaaatggtatcctccgggcggagaataggctccgtgtgtttggtccacggcggattatatccatgcgtgcgcattactggattcttcacatcctccaggcagcccgcttcataaaaagactttccgttcagatatacatctcccgtatgtatctcatagccttccggctcattgatgcagggatagagaaaccagtcgcctgtcagcacctccgaataaggattgtaatccccgaacatggaattaggcacaacagccttccatacggtcccttccgtattctcccagttttggattctttccgagcctttaatgacaaccctttccccttctgccgcttcataggtgatacggcttatatcgctgtagcctgtatgggcgggctttacccattccctgtattctccctcatggacaataaccttgtcccctgtctccgcagcagccgcagcctttgaaattgtccggaacggattttcctttgtcccttcggcatggtcgcagccgtttaccgatacatgaaattctctgttcattgcgtcctccattccgccgcacaggcggcgttttataaataagcagttcagcttctgcgcccgcagggcagcctttcatccccgcatccgcaaaacccggattatataacttcagcatacaaaaaggaaaagaaaaatacaatgcatttccttgcaggaattcaccaattcttgctattatcactcccgtctgcccgcgggaatcaaagacagccggaagcgtgcgcctgcttccggctgtctttaggttattcattcatgaaactgctttttctgttctgcttaattggaacgctggatttccagcactttataggtaatggtgcccgcctgggtctccacttcaacgacatcgccctctttagctccgatgagcgctttgcccacgggagattcattggaaatctttcccttcaggctgttggcctctgtggatcctacgattttatattccagttcttcattatattccatatccaggattctcacgcggcagccgatgttgatcttctccagatccacttcgtcttccactaccacttccgcattcttcaggattttttccagttcttcaattctggcttcgatatccctctgttcgtccttggcagcatcatattctgcattttcggaaaggtctccctgttccctggcctctttgattttctgtgccacttcctgtctttttaccactttcagattatgcagctcgtcctcatacttgcgaagtccttcataagtaaggatatttttcttctcttccatttctttctccctttcttaataaatctttctcgtccgtaccttacggttgattccgggcagttcctgcagaggccggtcaaggtcagcacaagaatatggcaatgctttaactacaagcaatgccatattttcgctgcagggctcatcacaccattttctaccatttaaccatattccaatttaagcaaatcagaaattacattctttatacaatacaatccaccgtttcactttcagtaacggttcgtattatacctttttctcacataagtgtcaaggaaattcagggcactcacataacaaatatcctttcttttcaccgaaaggagcctctccttttccggatcagaggtcatatccagataaagcagcttccggggcagttttcggaagggaatccggtatccgggacgcatatctatgcatatcccgtcatcaaaaccatgggcggcggcagtccccgcacagatgacaggcaggccggtatcctgataaatatgggcatagtacggtacttcttcttccagggatatctgtatctcttcgttttccaaaacccggcttatcagcagcaatccgttcagggcgccgtaatcctcccccaggaattgcctgaggcagtccgcttcttccccgatttcttcataaaagtcttccttcccgaaatccggcatcaccacaatcatactgcggcaggatttctgttccttccagaacagcctcatcagctccgtctccggaactccgggcctccaggcatatatcctccggatttcaggcgccagccacagctggccggatgaacccgcccattccagccattccggaagccgtttctttaatttatcaggcttcttcatccagttctccggaagcatataaaaagaaaggcttgcctcttcctctgcctcctgccacatgagaggtctgtttctctgtacaaaaaaatttcccagcccgctccggacaaccggcatctgtgataatgttcccctgtcccagggtaaaaatgcattcacatatatcatgcttaaggttatgccggatcggggcttttcatgcagataatttcctccaattgctccatcgtttccatttcattgatacgttcccgcagtcttgcggaatgaggatagccggccgtataccagcacacatgctttctcatctcccggacagccgtatattctcctttatattccttcagcagggcggcatggcgcagcatcatcgtccgcacttcctccatggaaggcctggggagcagctcccccgtttccagatagtggatcgtctgccggaaaatccacgggtttcccctggcggcacgcccgataagcaccgcgtcacagccggtttctctgagcatcctttctgcggattccggcccggtcacatccccgtttccgataaccggtatggttaacgcttcttttacccttctgatgatatcccagtcggcgctgcctgcataatactgctccctggtgcgtccgtgcaccgccacggccgcggccccgctttcctgggcaatacgggcaatttccgccgcattgacatgctcctcgtcaaagccttttctgatttttaccgttactggcttcttaatggctccggcaacggcggatatgattttccccacgagcaccggattcttcatgagagcggagccttccccattatttaccaccttggggacgggacagcccatgttgatatccaggatggaaaatggcctttcttcaattcttttggccatctccgccatcagctccggatcggatccgaacagctgaagggataccggacgctccttttcatggatttccagaaggctttccgtatttttattcttataataaatggctttggcactcaccatttcactgcatacaaggcccgttcccatctccctgcagagcaaacgaaatggcaggtctgttacgcctgccatgggtgccagaaaaacctggttttccaaagtcacatttccaatctgtatttttgccatttccgtttcctgattttttgcactcctgaatcacgttcttacggccagcgcagtatatacgaagacctgccgaacaattatctgttctttccgtaaatataacgcagcccgtccagagtcagcgagctgtcataaatatcaatagaatccgtttcatccgaaataatacggcccaggccgcctgtcgccaccaccttcatgtcggcgatcccggtttcctttttcaccatattcacgatgtattcggtctgtcctatctgaccgtataccagtccggcctgcatgctggaaattgtttcctgcgccagaatgctcttcggtttcttaatttccaccataggaagtcttgcggtatcctcccacagggccttggcggaaatacgtatccccggagccgtaattcctgccgcaaagcagccgtccgcggtcacataatcataggtggtagccgttccgaaatccaggacaagcacggggccgccatatttttcatatgcggctgccgcatccacaatacggtcaggcccgatttccttgggattttccgtaatgattcgtatgccggtcttggttcccgctcccacaatgagcgggggcgttcccagatatctggtaataccgcccaccagggaatgcatgatattgggaacaacgctggcaacaatggttccttctatctgatcctttgaaattccgtcaaacatcagcagctgcctgatattcatcccatactcgtccgaggtatggagcattttggacatcatacgaaaggttgttaccagctttttcccctcgtatacaccaaatgtaatattggtatttcccacatcaattactaatatcattcgtcaacctcgccttcttcgacctcttccaggaaatcagccacattttcatgcagcaccatggccctgtaataaaggctcaaggactcaagcagttcccgtcttttcctgcggatctctcccagcaaaaggccgctgctcacttcgtcatataaaaaatcctcttcggccgccgttgtttccagcgtcactccgccgtccggctcataaataatggtaaaaatcccgcccacatcctcggtgtacagtacacacaggatatgcagctcctcctgcacggatttgggaagcattttgaaatccgggttgaaataatatttctgttcataggaattggcgccgcacagcacaatgcggccatctccgctttttcccgtattccagccgttctccccgctttccctgcccgtcatttccttcctgtcactcatttctggctccatttccgcatcacacaggcattccgcccgcttttttcattaaacatatccataaacgccccgcacagaaacctctccggcataaacgttcacaatcccgttttgctccgtttccaccagaagctcccctttttcgttgattcccctggcaattccgtcaaattccccctttgggtcaaggacacgcacccgggcatccttattcaggagaaacctgtggtaggaagggagaagctccgtcaggtcccatgttttccggaaagccccgtaagcctcttcgaaatgatccatcactgatacaagcaaagcggaacgggatattttttctcccttttccagcctcagcgaagtggctgtcctgctgatttcagaggggaattcctcttggtttacgttgatgccgcatccgatcaccacataatggatataatccggctcggcgctcatttcggtcagaatcccacagattttctttccggacagaacgatatcatttggccatttgatacccgcttccagccccagctcattcactgcctccgccacggcgagagccattaccagggtgagcatgcaggcctgatccgggttgcagtccggccgcagaagaagcgtgaaataaaggttgcagccctgaggtgaactccagtcccttccccttcggcctcttcccgtgttctgacagtccgttaccaccagcgtaccttccggcgcgccgtcctctgccgcccttttcgcatcgatattcgtggagcctgtgctgggataaaaaatcaggctgttcccggcccaatggccctccccgcgggtctgaagacggcttcccagttcaatttcccctatcacatctggagaagccttcagccggtagcccttattctgtaccgcttcaatttcatagccctcttccttcagctgattgatcactttccagacagccgttctggataccccaaaacggctgcaaagctcctggcccgatatatattccctgcctgtcggcgcatctgctgccttttcccggagcatgctttcccggagcagcgaaagaatttctgatttcatgaaattgtaagcactcctttaccggttcctgtttcagaattcatagcccaaagaagccgccatgaccgctttgatcgtatgcatcctgttttccgcctcatcaaacacaacggaagccggggactcaaacacctcattggatacttccatttcattgattccgaatttttctccgatttccttcccaatcctggtatgcaggtcgtggaatgcagggagacagtgcataaagatagcatttcccgcattttccataattttgctgtttacctggtaaggggaaagcagacggatacgttcttcccatacatagtccggctcgcccatggatacccatacatcggtacagatcacatccgcatccttcgttccttccgcggcatcctccgtgagcgtgatgctacctccggtccgggccgcgatagccctgcactgctctgccagttcactgtcagggaagtattccttaggcgcgcaggcggtgaaatgcatacccatcttggcacaggccaccatataggaatttcccatattatagcgggcgtctcccatatataccagctttacgccctgtatccgccccagatgctccctgatggtcagcagatccgccagcatctgtgtgggatggaattcattggtcaggccgttccataccggaacccctgcatattgtgccagctcttctacaatattctgcccgaaaccgcggtattcgattccttcgtacattcttcccagcacccttgccgtatcggcaatgctttccttcttcccgatttgggagcctgaaggatccagatatgtagttccgagccccagatcgtgggccgccacttcaaaggcacacctcgtccgggtgctggtcttttcaaatatcagtgccacattttttccctgaaaacagtttaccgcaatcccttttttctttttatccttcaaatctgcggcaaggtctaaaagataggtgatctcctccggcgtataatccagcagttttaaaaaatgatgtcctttcagattcatagcattctctcctttcgtccttaaaatacgtgtcccagagccgggagggccctgacgaaaaagtctcacatccgtttcctctatgatgtgagacctttctccatttatttacacctgcgaaaagccgtcctccctgaaaaggggttccggacattgccgcatgcttttataacctgtctccggctcagccgttcagaatttccttggcagaagcgagcatgcctgccattccctgaatctcggaagggataatgatcttggttgcctttccgtccgcagccttttcgaatgcttccaggctcttaatcttcaatacggcctcgtcagcgcctgcttccctgataaaacggataccgtctgcagtcgcctgctgtaccttaagaatagcttccgcttcaccttccgcctcacggatcatcttttccttctccgcttccgcatgaaggattgcagactgcttctcaccttccgcttcaaggattgcagactgtttcttaccttctgcaacaaggacggtggatttcttctcaccctccgcacgaaggatggactcacgtctttcacgttccgccttcatctgcttctccatagcatcctggatagcagccggaggaatgatgtttttcagctctactctggtaaccttgattccccatggatctgtggcaacgtccagggacgcgcgcattttggtgttgatggtttctctggatgtcagcgtctgatccagctccagatcaccgataatgttacgaagggtggtagccgtcaggttctcaatagccatgatgggattttccacgccgtaagtatacagcttgggatccgtaatctggaaaaatactaccgtatcaatccgcatggttacgttatccttggtgataaccggctggggagcgaaatcaaccacctgctccttcaggttcacctttctggcgattttatcgatgaagggcattttcagtttgagccccacactccaggttccctgataagcgcctaatctttccacaacatatgcctgtgcctgaggcacaatcttgatacatgatgccagcaggataatgataagcacaagaataatcaacaacacaattgctccagtcatattacattccctctcttctttcttctacgattaattttactccgctgatggcgcggacaataactactgtccccttgggaatcttcatcccgtccaccacattccttgccgtccattcctgtccgttgatgctcaccagacccacggccagaagattatcgatgtcttccgtaaccacagcctgtttgcctatcagactctccgcatttgttttaatccggtccttgttaaaatatttcatggcaatcggccgggtaaacagcagcagtaccaccgatacgatcaggaacagcgtaatctgcacatacagcggtgtatttaaagccgccgcaatgatggcgacaaaagcgcctcccgcaaaccaaatggtggtaagccccatagttgcaatttctatggcaactaatattatcagcaaaatcagccagaatacaacctggttcatacaatttcctcctttccggcaagtgaaagcctacttctttcttaagtaaaagcacatttctttcactttctccataatactataatgcaaaaagatattcaatctttttagaatgaggaagcttaaatattttgtggaggagccacgtgaaagggctgcctgagccgcatgctttgccctcctgtttccggtttttctgtgtgggccgcggggctgcaaggttcctgtgcaggcacgctctcgctcggataaacgcgcagcggtactaacgctgcaaaggacgcagcgtaaggaccggcgtgtttatacggcctttacaggaatccttgcagccccgcggcccacacagaaaaaccggaaacaggagggcgggcatgcggctcaggcagccctttcactagtatagtgtggtactcagtgatgtgttatgcatgcggtactataggaaatataaaaaggagccggaagcgcggctccttgggttgggtaggaatagaaaatttaaaatgtttaccagaatacgtggttgccgataacgattccttcgcggttgccggcgcggcggaagtgggtggcgtttcctacgttggttatgccgtttatggcttcgttggcggcctggaggcagctgtttttgatggttccgctggacagcagggaggctactttgccggttccggcggggccgaattggccggaggcgtagatgacgccggaaattgtggaggggtaggatccgcttctgacgcggttgattactactgcgcctacggcaagctggccttcgtagctttcacctccggcttcgcattggatcagggctgcgaggagctgggcatcgctgacgcctgcggggactacgcctgcattttcttttttggtttcaccggccggtgtgtcggcttttgtacggccgcctttggctgtttctgcggaggcggtgattgcttttgtctgtgcggcttctctggcggctatttcctggagggtctcgccgctgtctacttcgaagtctacggagatgaagtcggaggagatatagccggtgcagccttcgtaatcgatggccgcccagtcttcacttaggtggattccatcgctgaactcaagttcgctctcgccgactacttcaaagctctcgcctctggcggccagggcgtatactccggcatccgggtcgggttctttgcggatgcggagggtgtctcctgtaaccgtagccatggttctgcctacctgtctggcttcctggacagcttcttcatcaaagaggaggtattcgtctttggcccagccgatcaggccgccggattccagtttggtccagccgtcttttctttccagaatggttccgccgcagtcggcatagaggtatcctattttctccgcttcttcatcaggttcttttctgacgttgagtgtattggatacgttggtcataaccagttccaattcttcttgtgtctttccggtatttttattctgttgtcttcccacactgacggcgagggcggcttcacccacacgtacttcctgttcagctgttttcagggaagcttcttccggaaccgtatcctcgtccaggattgccgccacgcctgctccgggattgtctgtgtctcccggctgtgccatggcttccgttccgaaagccatggcggaaacagtaaggattaaaagcgtcctgaggacgggaataaggctcttctgtttttcttgtgctgtcatagtttaacccctgtcaagtgctttcacactcttcccccactaaatgtactgccgtaaaagctgcagtttcttttgtttccaatttctgtatttattacagctatgttaacaattgttgcaaattttgtcaatatttgttaagtatttgttataaacaatttggggaatggctgcctttttgcggacgatgagggtggaatatgacagaaaacggccggattgcagtggttcacaatccggccgtgctttattttgccgccgtttatttatcggcttctttcttaatttatgggcttgtgtttagtagaaaacatggttgccgatgatctggccgcctcttccgtttgctcttctgaaatacagtttatcgcctaccggggaagaaccggctatggcttccacggccgcctgtctgcaggatgcactcactcttcctgtggataatgtgcgggaaaggctcccattgcgtaccgggctgaactggccggctgcataaatcacatccgggatgctggcggggtgtcctgctgattccacacggttcatgaccacatttcccacagccacctgtccgacatagggttctccgcccgcttcacactgaatcagggctgcaagcagatccacatcctgggggcttacccctgcctgtgctatcacggcttgctgtgcggcctgaactgccgcggcctgtgcttctgctgccgcttttgcggctgcctgttgtgctgcggcctgtgcttctgccgccgcttttctggctgcttcttctgctgctgcctgggcctgcactgctgctttcctggcggcttcttctgctgcggcctgtgcatctgccgctgctttctttgctgcttcttctgcggctttctgtatggccttctgttcttcggccgcttttgcggcttcctctgccttttgtgtttctattgctttctgctgttcgttgattctctgtgtatcctttgccgctgccatcacggcctgaaccgcttcgttctgtaccggttcagagttgctttctttttcttccgtctgttccttctgctctattttttcttccgtactgcccgtttgttctgtcttttccgggctctccggcacgatatcttccgttgtatcactgccgtttgtcaggtgttcactttccacccagccggtaatgtcaccgacctgtaccttcgtccagtcctcatcatgccccagtactactgcctgtgtaccggaaagctttaccagaaccggagaggtctcatcagcttctgcatggacatctgccacactggccgcatcaaccagcataacaccatttgccatagcggttgttccgcatgcagagctgagcaccataacaccggtcagccatccagcagcacgcttatacaaccttctgccatttgtgttcataaataacctccgtttttagttcctatggtcatcaggaacattttcacaattgttacaaacttgttaacaaatgttacgtttgatatcataccaacattattgccatttgtcaaccccttgatacaacaggcttaaaataagggttttcgacgtttttttactttaaattaactattatatgttttatatttttatattattacgtttcattttatcattacatcgacattatttttacaatattttcaatttatcttaatttttaacagcaaaaaagttgccaccacgtatttttttctacgcggagagcaacttttcttaagtttttctttatttagttatttaattgttacaaatattacataatattttacttttttgcaccgtctgtcataaaccgcctctgcctggatgcttcatacatcagaattcctgatgccattgcggcatttaaagattccacttttccgcccatgggtatttttatgtaggaatccgccagcgccgcggtttcttccttcagaccgttcccctcgtttcctatcagaaaagcgcttccgccgctgtagtccgcctggtcataccattgctttcctttcagatgcgcggcataaaccgtgatttttttttgtttcagtccggcaatcatgtcggagagggaagaaacatacaggaaagggacgcggtaaatgctccccatggtcgaacggatcgttttgggattataaatatcggccgtatcccggctcatgatcacaccgtcaattccggcgccctcaccggtacgcagtattgtccccagattgcccggatcctggatgtcttccagaagcatgagcagaggatttgctgcctgcagaaggtcatcaggggtatattgcttacgtttcatgacacagagtatcccctggggggtggaggtatcgctcatcttccggaagacctcttccgatacctgttccgcatgaaggccgttcagcttcctgtcgcaggcagggttatgaaagccttccgatacatacacctcttcgatttcctcttcaggcgcttccaggaacattttcaccccttccaccacatatctgccctcctgcctgcgttccttcgccttctggttcagagcagccacttttttaatacgggtattggatgccgatgtaatcatttctatctccttttacagctgtttggacagtttttttgccgtttcatgggaagcgaggacaataagatgctccccttcttcaatataatcatccgcggacggcatgatctgggactcgtagccctcccgctttatgccgattattgtcacacggaaacgggcggcaatattggattcccggatggttttgcccacccattccttcatggggctgatctcgtatatcccgtaatgggatgatatctcaatgtagtcgaatacattatccatgctgtattttgccgcacagcgctccgctatatctttttccggatagatgacctcatccgccccgttgcgcaggaggaatttggcctggatatccctggtcgccttgctgaccacatgctttccgcccatttccttcaccaggctggttatttccaggctgctctggaaattggtaccgatacatacaaaaatcacgtcaaaattccctatgcccaggctgcggagcacctccgggttggtgcagtcccctattttggagctggtcgcatagggcacaagaccctccagctttttttcgtccacatcaatgatcatcacatcgttttccagatcaagaagattggaagcaagatgctgtccaaaacgtcccaaaccgatcacaagcatagatttcatcttatttttatcctccttgttttgcggagcaaaatgtcctctgacgggcagaggatcttactcccggacttatcccaccactattttttccacgggctgctttaccggcggttccggcttgcttctggcaaataccagggtaaaggtaaggcttcccagcctgccgcagtacatcagcagaataatgacaatgcgggataccggaaccagctccctcgtaactcccgtagtcattccaaccgtaccgatggctgaaaaaacctcaaaaagcgtgtccgtaagcttcaggggctgtacagccataataatcagcgcagcggctaccgccaggcttaaatctatagtgacgatggcactggctttttttaccgtatcctcttccaggcgcctgtttagtatatttactccatgtgttccccttatcatggctatggtggaaagcagcatgaccaccgctgtggtcaccttcacaccgcctgcggtggagccggagcttcctccgatgaacatcagaaccatggtaaggaacttgctggattccttcatggccgcggtatccacgctgttaaaacctgccgttcggggcgtaactgcgctgaaaagggctcccaaaagctgttccttcccgctcatgcctgcgaacacattatccttttccagcagataaaaaaggagggctcctccgaaaatcaatacggctgtggttatcagcacaattttggtatgcaggagatattttttgaaacgcagcccgttcctctggatatcatcccatacaaggaagccggttccgcctatgatgatgagggccattaccgtgaaattcacgaggatgtccccttcataggatacaagggagctgtaggcttcgttaatccccattaaatcaaagcccgcgttgcagaacgcggataccgcatggaaaagccccatatagcagccccgcagcagtccgtattgagggacaaaacgcagggacagaagcagcgccccggtgagttcaaaggcgaaggttcccatgacgatcttgcgtacaagcctcaccactcccgccagctccatggtgctcacgctctcatggatagccgtcctctccttcaggccgattttctttttcatgaccaccgcaatatagctgccaatcgtaataaagccaagaccgccgatctgaatcagcgtaaggatgaccagctggccgaacaggctccagttctgatatgtgtcggccactaccagtcccgttacgcaggttgcggaggtcgcagtaaaaagagcatccagaaagggcatgcattccctgcttttggtcgcaaagggcaggctcagaagaagagcacctatcaggataatgagcgcaaaaccaagggccagcattctggtgtaagacattttggttttcttttttgtaagcataaatttcctctgacaaacagtaaggcgccggttcccaccggacgcctcattttttttggaattccccggcaaaggggcattcgttattttccagccgcctgactatactgcaagcagcttgctgattttgtattcatattccggaatatccttctgcatcgccagggcttcctcgatatcaaaatccttgaattctccgtgacggtagcctaccacccggttggttttcccttcgcagagtatatccgccgcaaggcagcccatgatggaagcgtaataccggtccttacaggtagggcttccgccgcgctgcatgtatcccagtatggtcgctctcgtttccacgccggtcgcggcttcaattcttctggccatggatgtggaatggccgattccttcggcattgatgatcaggtgatgggttttgccgcgttttctgttgttgatgatattgttgatgatattctgttcgttatagtcatacttttcagggagaaggatatcctccgcgccattggcgacaccgcaccaaagtgcgatatatcctgcattcctgcccataacctcaatgatgctgcagcgttcatgagaggaagaggtatcccttaccttatcaatggcctgcatggccgtatttacagccgtatcgaagcctatggtataatccgtgcatgcgatgtccaaatcaatggtcccgggaaggccaatcgtattaatcccgtggcgggacagcgcctgcgcgccctggtaagagccgtcgccgccgataaccacaagtccgtcaatgccgtgcttgcggcagatgtcggctcccttctgctgtccggcctctgttttgaattcctggcaccgggccgttcccagtatggttccgcctctctgaatgatgtcggaaacgctgcgggcctgcatatccacgatctcttcatttaaaaggccctgatagcctcttttaattccctttacattaacgccgttggtgattgccttcctgacaacggcacgtatggcggcattcatgcccggcgcgtcaccgccgcttgtcagtatccctattgtcttaattgccttagccatgatttatcctccagtctgccgcttcgggcattccctgtatgtgacttaacttttgcttttattttaatcgatatgtgtactgttttcaatctttttctttgcagacctaccgcagaccttccggactatatcaccttgatattttcttccccgtacagctcttccagccgggaaagaagttccttgtccgccctgacattccggttggggggcaatgcctttttcgccttgggattttccacataaatcacgactccgtcgtttccgtcagactcggccagcgtttccatcagctgcttttccgccgtttcgtattcctgcatggtcgggaacttgatccagagagtcttgcggatatcatcaaaagcctggatggattcgcagataatctttccgtccttgtcttcctccgcagataccctgcccttcacgaagaccttattttcctccgtcagcttcgcgctttcctgctcataaaccttgggaaaaacaagcacctcgatacttcccaccagatcctccagcgtgagaaaggccatgattttatcatttttggtgtatttgattttcttttcggcgatcatgccgccaaccgtcacccgttcctggtcacggacattcatttcaccggtttcctcgtcgatcataaagtccgcggtggttcttgtgatatgctttctccaggtctgctcatactcctccaggggatgcccgctgatataaattcccaggacttccttttcaaagccaagcagcagctctttagagtattcccccacatcgggaagacgaatctcaaaatcgcttttttcttcttcactgacgagatcaaacaggctgatctggcctgccaggttatttttcttattgtgctgctgagaatccatcatttgtgcgaatacgctcataaactgctttctggttcccccaagcccgtcaaaagtaccggatttaataaagttttccacggtacgcttattcacttccgagtccgccatacgggtgacaaaatcctgaaggctcaggaaagggcctctgaccgtgcgttcctccgtcacagcgtcaatcaccggccttcccacacccttgatggctgtgagcgcgtaccggatggaaccgcccgacacggaaaagcccgcttccccttcattgatatccgggggcaggattttgatgcccatgctccggcaggtgaggatatattccgatacctttccgggattatcaatcacggaggtcatcaatgccgccatgaattccagcgggtaataatatttcaggtaagcggtctggtaagaaaccaccgcgtaacaggccgcatgggatttattgaaagcgtatttggcaaaatccatcatttcttcataaatggtccccgccacctgctccgatattccgttattcacacagcccggaacgccttcttcttcatttccgtaaatgaaattggctctttctttttccatgacggactgttttttcttactcatggcacggcgcaccaggtcgcttcggcccatggtatacccgcccagatcacgcacgatctgcataacctgctcctggtaaacaatacagccgtaggtaggctccagaataggctgaagctgcggacacagataggtgatgctggccgcattgttcttccccttgatatacctggggataaaatccatggggccgggacggtacagggaaatccccgcaatgatatcctccaggttccggggcttaagctccttcatgaagttcttcatcccaccgctttccagctggaacacgccatcggttcttccggtgccgatggaatccaggacagccttgtcgttgaaatcaatattatcgatatccaggctgatatccttatccttttttatcagctttaccgcattctggattaccgtcagggtacgcaggcccaggaaatccattttcagaagccccagttcttccagagtggtcatggtaaactgggtggtgatacagccgtcggagcctctggaaagcggaacgtattcatccgcgctggccggacagataaccacgccggccgcatgcatggaggtatgcctgggaaggccctccagacgcttgctcatatcgataagcacctttacctgctcatcggtttcatagagcttcctcagctcgggattggcctgcagggccctgtcaatggtgacattcagctcattcggtatcattttggcaataccgtccacgtaggaataggggagatccattacccttcccacatcccggataacccccttcgccgccatggtaccgaaggtcacgatctggaccaccttctccgcgccgtatttctttcccacataatctatgacctcctgccgtcttttgaaacagaagtcaatatcaatatccggcatggaaacacgttccgggttaaggaaacgttcaaacagcagattatattttatcggatcaatgttggtgattttcaggcagtaggatacgatacttcccgccgccgatcctcttcccggtccgaccatgatatcgttgctcttggcataattgataaaatcccacacgatgaggaagtaatccacatatcccatacgctggattatccccagctcatagtccagtcgttctctcagcgtgccgtcgtcctccggataacgttccttcaagccgtcggtgcagagcttgttcagatagctccaggaatcatatccctcaggcacttcaaaatgaggcagcttcgtcacgccgaattcgatttccacgttgcagcgatccgcaataatctgggtattctccacggcttcccaagcataggggaacagccccttcatttcttcttcgcttttcacataatactggccgccctcatatcgcattctgtcctcatcagccagctttttggctgtctggatacacaggaggatatcatggggcttttcatcctcccggtacgtataatgcacgtcgttggtagccacaagagggatatccagctccttgctcatggaaagaagcgccgtgttcaccgtacgctgggtgggaatcccatgatcctgaagttccaggaaataattatcttttccaaaacaggcctggtatttcagcgccgcttttttggcttcgtcaatcaggcctttctggatatagcgggccacctctcctgccagacaggcggaaagggctatgattccctcatggtaacggttcaggatttccatatccaccctgggcttataataatagccttcggtgaagcctttgctcacgattttcatcagattggcatagccggtgttgttttccgccagaaggacgagatggtaataccggtcatctccgccggtcagctctttgtcaaaccgggaattgggagccacataaacctcacagccgatgatgggtttgatcccggcctccttggcggccctgtagaagtcgataaccccatacataacgccatggtcggtgatggccgcactgtccatccccagctcttttaccctcttcacatattcctttatcttattcgacccgtccagaaggctgtactccgtatggacgtgaagatgtgcaaatgccatgaattatgaactcctttcccggacaaacatgcccttatttttctccattccgaaacgcttccggaaccagtcgcacttacataaaaaagagtagtaaatgttcaggccgcagccatgcatggtttcaaagttgccctgtccctttgccacaatcacgtccgcctcctccagaaggcgcctggcgtccgctcccacatagtccaggggcgtccctgccacaccgcagccgttatccgtgatcctggccgccttatccaggcctgtctgtatggcatcctcaatcgtggcgtcgttcaatgccgcttctcccctcaccatgacggtgatatcaaggccgggaaaacgtttcttcaattcttccacagccagcttgtcacagaccacctctccgcagttatccgtcacatatatcattttccgtgccttccccagatcggaaagcatctcttcatataccttttcatccatactgtctccggcggccttttccagcagctgaaacagggtttccttctccacctggcccgccatgccgaaatcaatataattggcagccctggcgaatacaaatgccgtatgtaagggatccttccccgcttccatcacagaacggatatccggttccagagatagcatcagatcattgaattctttttttatctcatcataatccgtaaccggcccgaaatactgccggtatacctcgttgatcctctccaccagcaccggggcagaatcctccggggcactttccccaataatccgggcgacctgccgcatataggcatctctatcctcttcttttcctttatccctgactctttcttcctgcctgtccacaagacagcgtatacaagatgcacataatttcatattattatcatacctttctgtaatccttgctgccggttcatatatcaaataattgtaccatgattgagcgggcaaaacaatgcggaaaaaagcaccggcttttaaccggtgctttcctgaaaacttactttcttcttattaaatagatcacgcttccgcaatatcccattaccagggaaacaaacgccgccataccttctatatttacaggaagtcccagcaggttttttgccgcggccccgataagcagcccggccgccagccatactatggtacttaaaagcaaaatcaacttaggcggcaatttgtacagaaaagcaaactgacctttttccatgtcatataccctgttttccatataaattcctcctttctgaatcaagcgtaacaaatcccacactttatatctatccgaaaagagaaaaatttatgtaaaatcaaggtaaagtattatggtttacagatattttcttaaagcatccgctttatccagcttctcccagggcaaatccagatcatggcgtccgaagtgtccgtatgctgcggtctgtttgtaaatgggacggcgcagatccagcattttgataattcccgcgggtcttaagtcaaagttatcacggatgatttccaccagcttctcatcggaaagcctgcctgttccgtaggtatccaccatgatggatgtaggatgggccacaccgatggcataggagagctggatttcgcatttatcggcaaggcctgccgcaacgatattcttcgctacataacgggccgcatacgctgcggaacggtcaaccttggtgcagtcctttccggaaaaagcgccgccgccgtgacgggcatagccgccgtaggtatccactatgatcttacgtcctgtcaggccgctgtccccgttgggtccgccgatgacaaagcgtccggtggggttgatgaaaaacttggtttcgtcatcgatcatctctgcgggcagaatgggatcgaatacatattttttgatatcttcatggatctgttcctgagtcacatccgcgtcatgctgcgtggaaagcactaccgcttctaggcggacaggcttctcattttcatcatattccacggtgacctggctctttccgtccggtctcaggtaaggaagggtgccgtccttacgcaccttggtaagctgtctcaccagcttatgggcaaggctgatggcataaggcatatactcttctgtttcgttggtggcaaaaccgaacatcattccctgatcgcctgcgccgatggcgtccagctgggcttctgtcattttatgctctgccgataccttttcttcctcttttgcttccagagccttatccacgcccaaagcaatgtctgcggactgttcgtccagcgccaccataacgccgcaggtattggcgtcaaatccgtattcagacttggtataaccgatttcccttacggtatcgcgtacgattttctggatatccacataggcgtttgtggtgatttcgcccatcaccagaacaaggcccgtggtggtacaggtttcacaggccacacggctcatgggatcctgttccatcagtgcgtcaagcaccgcatcggagatcgcatcgcacattttatcgggatgcccttccgttacggattcggatgtaaataaatgtttctccatttttcctcctttggacaatgatttgtcctgcaaatgcagcagcaaaaagtatttgccgcacaaaaaagtccgctgtataagcggacccgatgttaatgataatcaaatcctcttattgttcgaaaagctcgctcaggttggcaccttcctttgaggggttgccgtggcttcgcaggtcctatgtacctccaccactctgaataagagatgatacaatattgaattttcttatctgtgactacgctcctacaatacaccataaatatctgtctgtcaacgggacaaattgataaaaatgtgcaatacggtattcagactactttaaagcggaatttcttgatatctctttcattatccactttttcgatctgcgctccgaggccgcggagcttttccgggaaattctcatagcctctttcgatatagcgtatatcatctaccgtggaaacgccttccgctgccaatgccgctatcaccagcgctgcgcctgccctgagatcgggagcggtaatgctggcgcctgtatatctggcaaccccgtcaatgatggcggtattcccttccaccttaatgctggctcccatcctggtgagctcatccacatatttgaaacggttctcaaaaatactttcggtaacaatgcttgtcccctgggaaagtcccagcgcaacggtgatctgcggctgcatgtccgtagggaagccgggataaggcagtgtcttcacatgggtatgggtcaggggcctggaggccacaactcttaccgcatcgtcggattcttccacttcacagccgatttccatgagcttggcgctgatggattccagatgcttgggaattacattcttaacggtcacatccccctgcgtcgccgcagccgcgaacataaatgtccccgcctcgatctgatccggaatgatggcatattctgttttgtgaagcttctgtacgccgcggatacggatcacatccgtacctgcgcctttaatattcgctcccatactgttcaggaaattggccaaatcaacaacatggggctctttcgccgcattttcaataatagtcatgccatcggccatggccgccgccatcatcacgttaatcgtagctccgacgctcaccacatccatatatacatggctgcccttcaggttcggcgcttctgtaataataagtccgtgctcgatgcgcacatcggcgcccagagccttaaagcctttgatatgctggtcaatcggacggcttccgatgttgcagccgccgggaagcgcaacctccgctttattgtatttccccaaaagcgctcccagaagataataggaagccctgatttttttaataaaatcatcctcaatcacaagatcatggatatgggatgcattcaccttgaccgtatgcgtatcaacacgatccacaatcacacctatgctctgcattgcctgcagcaggatattcgtgtcccgcacgtcaggcatattttctatcaaaactgtttcatcagtcataaccgaagctgccagtatggcaagcgccgcattcttggcaccgcctatttccacttctccgacaagcggatttccgccttcaaccacatattgttccatattaacctcattatgtatgcaggccgcgtatcagatactctcgttcgagacagtcccatacaataccaacataccgattcttactcacgatttttgttaactgcagattatgcgcagcatacaccgcctgtttaaatatttatcgttatgaattattattgtctgtcctaaattctttatgcaaaacccgattagtaaaatctgacatacaaattttcgattattataccatatatacaaaacttttgccacttaataatccaaaagcgattatatcatatttttttactttgtaaatgagtaattccttaaagggcaggtaaacccataaatttacaaaaaaaatcccctctgacaaagagcggaaacgaacttgtccgtaatccgtactatcagagggaaaaataattattagttgagatatttaagcgggttgaccgcctgtccgtttatacgtatttcaaaatgcacatgaggtcccgtgctgcggccggtattgccgctgagagcaattttctggccctggctgacctgctgtcccaccgaaaccagcaccttgctcaaatgtccgtagcgggtttcccgtccgtcggcatgctggatataaaccacatacccataaccgctgccccagcctgcccttgtaaccgttccgccggaggatgccataaccgccgttcccaccggcgtcgcccagtcgattccctgatgataggtggacgcacccttggtaggagcgctcctgcccccgaaattggaagaaaggcgtccgccggaaatcggcttgatataggtgggaggcaccttggttcctctttttacaatcttgggaaccgcctcataatccacttcctccaggatgatctcctctcccagttcctctgcattcttgtaagtaatgacactggccaccctgcggtgtcctgcagaaggctcctgcaccacctcctgtttggtcgtataccagtcatccacatccacatactgaaccggcgcgtcatagctctcctccgcataaaccagctcttcatgaataacagaaagctccggctccggcacagttataatcagctcatcgcccacacgtatggtggattccgcactttccagggagggattgatggcaaccagcccgtccacggtgaggccgttatccaatgcgatctgggaaagggtgtttccgggctgcacctcatagatctgttccttttcctgctccttcgtcacctgatcaatggcatcgttcaggctggtgatttcatcctccatgagataggcttccacaacctctaccgtatccgcataagacagctttttcagcccatagtccagagtatcaaaatcacccacaatcccgggtgcggcagcctcgcatatctcgtccatgaacagggcgatacccgcggccgtatccacctcatccggatccttaagctcttccttcctgcagatggaagtggtaagcacattcagctcccgcatcggatccaccacaagctccactgcatattcgcctgtgggatcgtatttttccagacaggcatgaaggagtgccaaaacctcttcgctcgtcttcagatttaccgtatattcgttaatctttaccgtgtatgcgtgctgaagtattttgcaggtgctgctgcttaatacctcttccatattcttacggatggcgtcctcgctgtctaccctgccgaccaccatacgcctgccctgaagttccatgtccgccgtcataaagaccagctccccgctgtctctcacaagctcttcccttgcactctgaagaaactcctccgctttttccggctcatccgtgcatcccaccagcgtcccgttcagcagaatatccgccacattattttccccgcggacatatctgccgaaggagggcacaaaaaggacagcggctgctatgatgcagaacgccgtcaaaagaaaggtagctcttaatcttttataatattttgtaatactttccatgaatcccgcttttcttcccgcaaactattttttcttcttcgcaacactgtatccaaacttacctattgccttgcccagggcaaaatacatgccgtgggaatagcatataggatcggctttctccagatggaaccggttattcttgtccagatacgcctcatccacactgacggataccacctccgccacaaacatggtatggcttcccagagccatagcctgcctgaccctgcattccagactcaccgggctttcctttataagaggcaccttcactgccttccccggaaccggggtcaggtgtgcctccttccatttatccgtatccctgccgctcttcacgccgcacaggtctgtggcaaaagccagcttctgcgtggtcaggttaatgacaaattcccctgtttcctgcagcatggcataagaatatctttccggccggaccgaaatcgaaaccatgggaggattgctgcatacggttcccgcccacgctacggtaagaatattgctgttcccggccttatcggcacagcttaccatcaccgccggaagcgggtacagcatattgccgggcttccattcttgctttcccattgaatccgccttgctccttcctgtctgtgttcatgcagaaacttcctacacaccaagtattcccagaatttgtaaaataaacagggccgcattcgccagggtgacagccagtgttatgatcagcatgggcttcagcccccggttggcttctttcagttcttccgtctgtttttttacttcttccaccacaacggcctgtacattacggtaaaccttcacattttccctgtgggtaaactcatccgtttccttctgcatctcccgcaggctttccgtctgccctgccacaagctcacggatttcatccactctttccgcggtttccacattccggttattcacctccagaatccgggaaacactctcctccgcaagcgctttgatctgggaaaggctttcttcggtcacaccttccagctgctgcaggcttacctctgccagatgggaaagcttctggagcccatcctctgccagacggttcagcccttcttctccggtcctggccacaccggcaatcccggcgctcccattctccgccatctcctgcaggctgctgcttctgtccgcagaatatctgcgcagacctgaagcgcattcctccgccagcttctgtaccccgtgaaggctttcctccgccagcttctgcattcccgccgcgctttcttccgtcagcttctgaatgcctgccgcgcttttatccgtataacgctggatcacatccagcgtttccacatttttcatgttggattttctcatttcctgaaggtatccgtcatattccaccaactggttcctgagacgctttgcttcctgggcatccggtgtcaaggcgcccgcagatcctccccggtaagcctggtcttcattgtaattatccatctgacatttcctcctgagtaaacctaaaacctgtttgacaaaacagatacactcccactattttccccattttagcattattccctgctttttacaaccggttattactgcctctttctcatgcgggtacgggttttttgtatattatgcactatttttcattaatgtcattttcttttttattataattaactatacatttacaacttgttcatagtttattcataaatcattgttatactatgttcataagttcaaaggaaacaaacgtaacaatccattagcaaacatagataaattttttcataatagccccggtgcttatagcatcggggcactcctcatttttaggggactctttttctttctcaacaaaaaaagccgcataagactgaattttccagtcctacacagcttcctatatctatctatttatctattgcgacagccttacgccatcaatcttccgtttccccactcaggctgaggatttcctcattaagcgacagcatcctcgcgtccagatccgacaccatcctggcacactccaccagctctgttttgatatgctgaggggcattcccttcaaacttgtaattaatcttatgctccaggcttgcccagaaatccatggcgaccgtccgtatctggatttccactttgacctctacaatacggtcagataaaaaaacagggacggtaaccagcatatgatagcttttatagccgctggccttagggtgcttcatataatccttcacggaaatcactttgatatcattctggtttcttatcatatccgcaatccgataaatatctgatgtaaaagaacagatgacacggattcccgcaatgtcattgatatatttcaccatattttcaatggtggattcataaccgtatctcttcagcttctttacaatgctttccgaagttttcatgcgggactttatatgctcgatagggttataacgatgcacatgctggaattcatcattcaggatttccagttttgtattaatctgcttcaatgccgcattatagaccagggtgacctcctgccagctgtcaacctggttatcattatctaccacatattccattttcttcatcctcgatttaacttttatacgggtttattataccatagatttaccgtaaacatggatagtttacaaaaaattaataataagcaatcggattttgtaaaaaaagccggtttccctggtaaaatacctgtaaaacaatatttatgcatcctctgttataattataccctgatttgccgccgctattgcgtttttatctattttcagctacactatgcttactcggatgaagcagtgcagtctcaggctttaagcaaagcatccggaatctaaagacaagaggtgttacctatgttccgtttatgggcaaaaatctttaaagacaatcgcatgctgaaagataccgtcatctgtgatgattctgatgataccagaactcataaggttttccatgccctggatgaaatctgttaccagtttgatttgggaaagcctatatggctggatgtgaccgtcctcgatttcaagaagcacagcaaggcccggtttaccccggataattttgtagagcagattgattttgattttcttgaaatacaggtgattgaagaagattagttattgcggttattgtgaatgaatattattcattgacttattttgttttgtatgctattctctgtctgagcgcagaaaaagggaggcgtattttatatgcagcggatcacgaaagcgcctgaagtacgcaggcaggaaattctggatactgccatcaggcttttttatgaaaatggatatgagaaaacatccatcaccgacatagccaatgccatgcatgtggcacagggtctgtgttaccggtattttccgtccaaggaagcgttgtttgacgccgctgtcgatcaatatgcggagctgctggccggccggtatgctgccgttctgaaacgcaccgatctcacgctggaacagataattctccaaatgcccggcttcatggaggtggaaacagacgataccttttcctataagctgtgtcacggctccgacagcatgaagactcattaccagctttccacatgtatctgccgcaagcttctgccttttgttacggatctgcttcttcgtgcaaaagaaaagagggaaattcatctgaacgatccggaaacggcggcatccttctgtctttacggacagctggggatccttcttcagaccgatctcccgggagaagaacggataagccgcataagggctttccttctggaatttctgcagcttgaacataaaaagagataaatctctgttaactgccctgccttatcggcagggattatatttaccattccaatgaataatattcattcatcacttgcaaagaaaggacaattattatggaaacaacacttgattttgtaaacggaaataccaggcgctgcctgttctccatggcgcttcccctgatcgccgccatgttcctgaacatggcctataacctggttgacagtctgtggatcggtaatcttctgggggaaactgcttatgccgccctgacgaactccactccgatcatcctcattctcagcgccattgccatgggggcatccaacggcatttccattcttctttcccaggcggttggagcaaaagatacggaaaaaacggaaagcctcatagccacttccctgtgcatcgccctgcttttttcggcaggcatcacggttctgctggaactgctgttaaaacctctgctgatttttctgcaaactccggatgaaaccttttccatggcctattcttatctgtctgtctatgtgctgggctatataacggtatttctgtattgttatttcacggcagttcttcgcagcttcggtaattccatttttcaaatgctcgccatgcttctgtgcacgctgctgaacacggttttggatcctctgtttatccgccgtttcggttttcagggcgcggcggcggccactcttctgtcacagacattgtgtcttgtatgtatgctggcttatttatggaagaaaaagctgttttccttccatatacacctctttgatccggcatttatctggcagtttctggcgaagggcattccttccgcctttcagcagagtattccggccatcagcaccagctttctcacctctcttatcagtacctatggcatcaccgcactggcggcatacggaattaccgggaagctggaaaccatactgttttatcctgcaatggccctgaatatggtccttacagccatcacaggacaatgtgtgggtgccaaacgctgtgaccgggcaaaagattatatcaaagcctctcttttgtatggctgcggccttctcctcttcctttctctctttgttgtgctgttctcagggcagctctccagcctctttgtaccgggcagtgcggcatccggaatcgtaaaacggtatttccttattgtaggggccggttatgttcttaacaccgtgaccaactgtttcctgggagcgctcaacgggatgggaatgccgtttaaaagcatgctctgtatggttctttattatttgatcatccgaatgcccctggcatggctgctgtccgccgcgggtcaggggctgaccggtatctgggcggcggttctaatcagccactgtattgccgcagctgcagccgctgttgtggggattctgcagcttcgttctctggaagccctgccttgtccttctgtttatattgaataaaaatcttaaaaacaaattgtatatttttattgacactcgaaataatatgctgtagtatcataatatatatgacgtagttatcataactacatgatacattttatattatctttcagctagtgtaaggaggcattttattatgagtgtaacaataagagaacccgggagtgcaataacccatttaatcggtatgatgatggctatcatcgcatccactcccttactgataaaagctgtattatccggtcagccggaggttttcgcagccatgattatatttatcgcaagcatggtgcttttgtacggagccagcgcaacctatcattccatcaacgcaggaggacgtatcctgagagtcttccgcaaaattgaccatatgatgattttcgtcctgatagcgggttcctatacgcctatctgcctggtggtgctgggcggaaagctgggttacactctgctggctgttgtatggggcgtggctattctgggtatgaccataaaggctgtgtggatcacctgtcccaaatggttttcctccgtcatctatattgcgatgggctggatttgcctggctgttttcggacagctgtggaatacgcttcccagagcagcatttatctggctgctggcgggcgggctgatttatacaataggaggtatcatctatgcgttaaagcttcctatctttaattccaaacacaaatacttcggttcccatgaaattttccatcttttcgttatgggaggaagcatctgtcatttcatattcatgtttaaatatgtggcataaaaaattatgattcttccacacaaagaacgggaacacaacggccaaaccgttgtgttcccgttcttatgtcagctgtcagtcattatttattctgcggattaccttacagggatttcccactgccaggcagttcggggggatatcctttgacacgacgctgcccgcgccgattacactgttatcgccaatggttactcccggcaggacaatgacgcctgtacaaatccagacattgtctccaatggtaaccggatgggtatattccagtccttcgatccgctgttttacgtccatggcatgttcttcggttatgatactgacgcccggcgcaataaaaacattgtttccgatggtaatttttccgctgtccatgagcctgccattgacattcaggaaaaaattatctcccactgatgtattatatccgtatgtgcagaaaaggggctgctccacgacgcagttttctcccacatggcccagcagttcccgtatggcggcctgccgtgcttcacggtcaaggggatggatattattatagtcatgcagcttttttacagtcacatcacggtctgccgccagttcaggatctcccggctggtaaagcatttccgcatgtgatttttctttttctgtcatagatttactccttccggttttcagatttatagtatttccttttcctcttcgtccgtttccttaaattccacacaggcagtgaataaatctgcctttatttcaatataaaagtttccctggcaggcctcggtaaagcttctcgctatggacagccccaggccgctgccgccgtcggtacggctgctgtcccccctggtaaaccgggctgtataatcaattgtctcggaaagctcttcggctgaggtattcgtcacactggcagtcagaaggccgttcttttcttccagggaaacatagactctggagccttccagcgaatactgcagggcattctggatcagattctggaaaacacggtacatccgctgtccgtccgcacggataaaatgctctccttcgggaatgcgggttcttacgatcacattggaatttttaatatcttcttccatatccgccagagtctgccgcagcagcttggcaaaatcaattgtttccggattgacagggagttcgccggacgcggctttgctcacttcaaacacatcctgtaccatggttttcagcctctgggatttgctttccagtatggaaatatagtcctttacatgatccggaagctcttcctcttctttcagcagttccacatagctgataatggacgtcagaggcgtcttgatgtcatgggaaacattggcaatcagctccaccttcatacgttcgctgcggacctgttcatcaatcgcttccttcattccctcccgtacttcgttcatgcaggttaccgcatcatgaagatcggaatctgccggtaaattcaggggagcctccatatccccttccctgacggcatagatctggtctaccaaatcacccatatccctggcatcccgccgaagggaacgaatataaacggtctgcgccgccgctgcggccaatattgccaagactgccgccgaccacaggatgacgccgttaaaggcgccaaaagatactcctttcccccacaaaaacataactgtaaggagaagcgcagtcataataacggatatgacaggcagtttgcggaatcttcttaccagccgcttctggaacggatattccatttctttactggaaagattgcggcggactttcacaaacaggctgtttttccataccttactgttcaggcgggcatcgttaaccacaagccagataagccagaaaacacaaaggatcagcgggcgtaattccatcagcgatagctgataataaacatcctgaaacaggtttccataattaagattttgggcctcagatgccatatcataagtcacaattaaggtggtatctaaaattccggacactttggaattaactataggcaccatataataaaccagaaccccagccggaacaagcacagccaaaatcttgatttcataccataacctgcctgtaaaacgagccagtccgttccttacatccctgatatccttacggaaaatgaaagcgatactcaaaaacagaaccgcagcgataaaactccgcaaaatccaagtgagtgaatttctggtaccctgcatggtttttactatttggtataacctgtttccaccggtataataggtatacccctgcccgtatacagcaacggtatactgtttggggtcctctgcagcggcaatggtaatcctggcatccttatatttatcgtccacagcgaaattttcatatccgggcacgaaccagcttccattatccgtatagataccattcccgtaaatatccagttctctgccgtccttttgaatatacaccttactgccgtcaaaataaagaaggaaattatatccgtcaggaagaagatgttcttccccgttcagctgcagatctcctgtattactgtacagttctttatcatcataggtaattgtatacaaaagatttttacagtctttcagcatctcatgggcttcatcggccgcccttctgttttcttccttctgatcctgggatgacattccggcatctgctgcatttgaactctccgcttctgcagaatcggccgattcggaaccttccgaaatctgtccagaccagtcggaggtattttccgtaacggcatcgttcccggctgattgttcgtcagacgcctctgccgccacactgtcggaagctccttccgaagatgttaccgtcacataggaagccgacgtcttccccagatctccctggattccgaccaccgctatattaccgtcccctccgtatccaaaggattccaccccataataactgctgtaggaaatcccccttgtacgcctgtcattattccaggaaaaatccactttccctcctgaagccatggaaaggaaatcctccagataaccttccatatagaactggaaggcggaggtattctgataatccggctgaaatgcatccttcatatcctctgttgttatacctcctgcaatcatggcaataatgtgcagaagatttcccagaaaaagggtgactcccagaaaaaaggctgtaaagcctatccatcttttactttttttccattttgtatccaattccccataccacctttaaatattctggctctttcggattcaactcgattttttcacggattctccggatatgtaccataactgtattttccggggcataagcctcttcatcccatacacgccggtatatttcctcagcaggaaacactcttcccaggttacgcatgaaaagctccataattttcgtctcggttgccgtaagctttaccgcttccccgtccgcatacagaattctttcatcggtacggaatgtaagccggccgtttgtcagttcttccgtctgttccgaggcatggatgtctcccagcctggtatacctgcgaagctggcttttcacccgggccgccagctcctggggattataaggctttgtcacgtagtcatccgcccccatggacaaacccagtattttgtccgagtcttcactcttggcgcttaacacgataatgggcagatttcttttttcacgtatccgcattactgccgacaagccatccaggcggggcatcatcacatctatgatgagcagctgtacctgatttcccgccaggatatccagcgcttccattccatcataggcccgcaaaaccctgtagtcttctttttccaacagaatggcaatggccttcacaatctctctgtcatcatccactaccaatatacattcattcatatccggccagttcctcctttgagcttgtattcagtgtaattcagatgtcttacgaacttacggcgggaattcttacaaatatcttacattccgggattatccgcagccattttgtatcaaaataccgtctgttttcagtttactacagaacacctcacggctcaatcaaaaaaagacagggtattctggtaattcaaaccaggataccctgtcactatgaaacatatcaataaaaagccctgttttacgatagaaacggacgcttaatcctcgtagccgttaggattctgtgactgccatttccaggaatcggcacacatttccttaataccgtattctgccttccagccgagctccgcctccgctttgcccgcgtcagaatagcaggttgcgatatcaccagggcggcgatctctgattacataaggaatcttaacgccggtagcttcctcaaaattctttacgatgtccagaacgctgtaaccctttccggttcccagattgtaaatgttcaggccggaattgtcttcgattttcttcagcgccttcacatggccttttgccagatccaccacatggatataatcccttacaccggttccgtcaggcgtatcataatcatttccgaatacattcagctctttcagctttccaaccgcaacctgagtaatatagggcatcaggttattagggataccattgggattttctcctatcgttccgctcttatgggcaccgatagggttgaaataacgaagcagtaccacattccattccggatccgctttctggatatcggaaagaatctgctccagcatggattttgtccagccataagggttcgtgcactgtcccttcggacattcctcagtgatgggaataaaggccggatccccgtaaacagtggcggaggatgagaatattatattctttacaccggctttacgcattacatccactaaagtcagggttcccgctatattattttcatagtactcccacggtttggcaactgattcgcctactgccttcagtcctgcaaaatgaatacaggaatcaattttttctttcttaaatacttcattcagggcatctctgtccagaatatccgccttataaaagggtacatgctttcctgtaatcgcttctacacgctgtaaagatttttcgctggagttactgaggttgtctaaaacaactacctcataccctgcattctgcagttccactaccgtatggctgccgatataaccggcgccgcctgttactaaaattgccatggctgctcctatctgcgactaaaatcgctgttatcaggaagggaaaaaagttccttcaccctttccgcctgtccgccgtaaacacggcatctaatcattctaaaattaccataaaacctcaggataaacaccatctgctttcagctttgcaatggattccataacaaagggcttatcctctttataagttactccgaaccatttgtctttggaagaaagaacctcaacagtggctttgccctgctgcaaaagcttatctacttcaataggaaggaagcactccgacttcatgggattcttcggcacttcgttcgcaaagaagttattgactgcactctccagttcatccaggatgcttgcggaaaagccccacatattcatggaaacaggagtgtccagcggaaggggaacccaggtggctccgtcatcttccgtataagcagcgccgtctgccgtttttacgatcttggtacgttcggcaatcgtcttcaggaatccgttttcatcagtcacacagcagcctctggctacggaaccattgtctgtaagggtgttgcccagttcatagcctaccattgcgtaacggtatttttcgtcgtcctgatgcgtggtaagaaaatcgtataatgtctggaaagcgcttcttccgtaataatcatctgcattaatcactgcaaaaggtccgttcaccacacccttgcagcagagaatcgcatgtgccgttccccagggtttcactctgccgtccggaatgctgaagccttccggaaccttggtaagctcctggaatacatattccacttcgatatgcttgctgactctgtcgcctacgcattcccggaaatccttttcattttctttcttgataatgaaaacgaccttcttaaatcctgccctgacagcatcaaacatggagaaatcaataattttatgtccctgttcgtccacagggtcaatctgtttcaatccgccgtaacggcttcccattcctgctgccagaattaccaataccggtttgtccatatcctgctctccttctgcgtgctttaacacgcggcaaaaggcagtgaagcttgcgtccatcctgtgaagttgttggatcattttgtaaagtctgcaggcctgcttcactttaccctttcattttatccgggaaccagtacattccgcaactcttatttgttaggaagagctgtcaaaatgttaactcggtttcccttgtttttattatcctgccggcctgccgcaaacgcattctgggattgcagcgattgggggccggcgctataagttattatatcataagcacaaaagggaatcaaattcccaaaaatggctttttttgtcacgtttaattcttgagacttgcattgccgtctgccttgtgtcttctgccggccctggccccttatgttctgccggtatggagggccgcgctgcaaggttcctgtgcgggcacgctttcgctcggataactacgcagcggtactaaggttgcaaaatacgcaacctaaggaccggcgtatttatacggcccttacaggaatccttgcagcgcggccctccataccggcagaacataaggggccagggctggcagaagacacaaggcagacggcaatgcaagtccggaaagttatgaaataaataaataaataaattaattaattatttagccggtgaccatatggcggaggatggggattttttcgaggaggagggtgaggaggagggccgggatgatcaggagcagggttttgaggaggttggtccagatggagaaggtggggaaaaggagggccaggcgggggaccagcatccagccgaagatccagtggagatagtagattccaagggttcttttggcaacggcggtaattgctttttgggggatggggcgggggatggtgaggtctttgcagattaggaaaatacctgctgcgaggaatacgaccgggaggtggcggtagccttgtacgaggaggattccgtcccaggcggggttctggctggtataggtctttacggcccacattcctgaaaggcctaaaagggatgacaggaggccgaggaggcgctgtctggtgaggctgccgcaaaaggtcggggctgtgtgaagccaggctccgaacaggaaaaagccgagcatgttggcgtaggtgccgaatggattgagtatttccaatccttccagggaatatacgccaagcaggccatgggcgcagagggcgtcgagcagcatctgcagtccggtgaggccgttggtcatcagaatgccgtaggcggcgaaaaacagaatgatttttcttccatgggtgtgatcataggcgattcggaataggggaaatagtatgtatacggctagaagggcttcgatgaaccacaggtgtccggttcctatgccttccaggctgccgaaagcgaacaggtacaggaggatctggtttttaccgaaattggccactggtacctggcacagggcgcctatggaaaagaggtaaatcagtttccagagcacgagcactatgtagataagaagggttttgcggatgtgttttgacaggttcaggggcctggtaaaaagcagggctccgtttaccatgaaaaacatggggactcctgaccagcaggctaccataaaaatgttggccggtatggtttccgcaagcaggacaaagtggcagaaaactaccagaaaaattgaaatcactttgattatgtccagatactggattctcttttgcatcctttttctcctgtttctttcattgttcagtccttaatatgatgaccggaatgttgaaggcggagccggttcaaaaaaataaggatagtatccggtacgtcctgtccggatactatccttagaatatgtgattcgctttatgatgtcaaccttatacccgattttaaagcccggaggttattccacttttttgaatttatccgctccctggccgcagacagggcatttgaaatctgcggggagttcgtcgccttcgtatacgtaaccgcatacctggcagacccattttccggtcttcttctcttctgttgaaggggcgtcttttccgtccacctccgggagataggtaggcgcgtttttaggcgctttgcctcttactaccttgtggtaataagcataggtcatggcattgtctgacttgccatagctttcggcttcaatgacctctccaaggaaaacggtgtgggtctgggtttccatggtatcaatcacgcggcagactacatagccgcaggagtcttttattaccggaagccctgccgccatctccatatccacatctttgaatttgtccgcttccctgctgctctggaatccaaaggttccgatcagggaaggatccgaattctcggataaaatggagaatgcaaatttaccggttttggcaatgcatgaattggtgtagttgtcatggttcacgcttaccgcaatggtagccggatccgatgtgatctgcataatgctgttggtgatgcatcccacagggcggtctccgtccaatgaggtggttacataaacgccataggacatatctctgaaaatcattgtattcattcttaaactcctccgtttttatatatactgatttattttgctgccggatcaggtcatggcagcgccgtctacggaaagcacagcctctgtgatgtaagacggcatatcgctggacaaaaacaggaaggtactggcgatattttccggctgccccattcttcccagcgggattgcattaataatcggttccatcatttccctgatgccccctgttacaaccgctgtctttccttctagcatccttacagccctcctttatgttggtttatattaaataatagtaatcattactaattttatagtatcataaacagattatttgtcaagggaaataccctttattttacaaattttacatttctcagcatattgataaaattcccgaaaaaacgaaacatcagaactgttatacaatactgcttcatcaaaataaaaactgtctgataaaagctttcccctactataaggaagcataccgtaatatggcattttctcttttttcttatgatctttttctgccttttagaatgccgaattcctttttcgatattgattccaggcaggtaaaatatactttgattcagaaataacacagatcagagaataatttggcttcccaaaaatccttctgtgtacagaattttcaggaagccgtcagcgcctgtagtttatttattggaaatctatactgccacaggtttgcctgccctgggctttaccaccttgatttccggatgcttcagggcaatagcccgcttaaagggtctggtgtccacgtcttccgataccggagggaaggcatcgtcaaagtgatccagcaggatacggcggggcttcagttcatccacaatctccattgcagcttccgccatattctcccttccctgaaaaggcagtatgaggagatccacgttcgttggatatatcgtattcttatccagggccatgctgcccagcaaaagaatcctttttccttcggcatcaatctgataggcaaccgtttctcccttttcaggaaatttgggatgcgcccaggctaaaaacagggtattcctgaaatagcggaacagccggggattaatcaacttccgcagcaccatccgggcagtaaaccttgtatgctgtcctttcagcatggtaatcttcatatttcccctgcgccagctgcagccaggctccgcctgcacaagagaaccggtctcttccacccagccttccagagtatccataaccgcttttgttccatatacggtaatatcctgctccgccaaaagatccggcaggaaaaaaagatgatccacgtgaccatgagtaatacagatatccgtatccgcagggaaatcttcaagagaattagggttgcttcctcccgccaactgcacgaagggatcaaacagcagcttttctccttccgcttccagtaaaatagaggccgttccaaaccaggtaatcttcatcttccgttctcctttttatgcccataagaagctgccggcagaactgcctttccgttcacttcagggtcaaactgtgtataattaagggcatcgacaatgtttttttgtcggcacccttatttttttataaaaatgttacagttcagcctgccatgccattcaatagcgcgggattcccggcactcaggtgttttctgacaggtctgcctgctccatgaattccccgactgttttggctttgaccgcttctgaaaaccattttttcagaagcgaaagatcggattctgaaagaattctctcccgcagactgtccggtatttcgcccagattctcaagcagctctattaaagtgtaccccttgtcaaggacaaatttaagaagaagggatactatgttctgaatagatattgttatatttctttttccttttctggttcatttattattcctctaagaggataatttccagttgttatatattggtaatactcatttggagatagctttgccaactgccattgatatctctcattattataataatccagccagtcatcaataattgttttaacctcttgaaagacggcgcaccggcttatatccacctcatctttcatatggccaaagaagctctcctgtggtgcattatcccaacagtttccccttctcgacatggactgtctcaatcctctatcctttactaattgaatgaaactacagcttgtataatgacagccctgatcgctatgaattatggcttcagcacttaacgacacaccgtgtttttctaccatccggtttactgtctgtagtacaaaatcaacttccagtgattcgctcaaaacataagacaatatctgttttgtaaaagcatctaaaattgtagacagatagcaaaatacaccattataagggatatatgttatatctgtcagcagtacccttctcgctccataagctgtgaattgtctttttaccagattgtctgcgacatgattggtctttattgcttttgccattcttctatatggatttgcagctcttattttacacacaagtccatactttttcatcaatcggcggatcttctttacattcataattatgggtggattttgatgtatcagcgtcatatagatgctctttgcgcccttatcatatccacgtttagcatacgctccaagaattatttcaaaatctgcctgatcttttaattccttcctctgtctttcatctgcggcccctgcccagcgatataaagtgtaccccttgtcaaggacaaatttaagaagaagggatactatgttctgaatagatattgttatatttcttcttccttttctggttcatttattattcctctaagaggataatttccagttgttatatattggtaatactcatttggagatagctttgccaactgccattgatatctctcattattataataatccagccagtcatcaataattgttttaacctcttgaaagacggtgcaccggcttatatccacctcatctttcatatggccaaagaagctctcctgtggtgcattatcccaacagtttccccttctcgacatggactgtctcaatcctctatcctttactaattgaatgaaactacagcttgtataatgacagccctgatcgctatgaattatggcttcagcacttaacgacacaccgtgtttttctaccatccggtttactgtctgtagtacaaaatcaacttccagtgattcgctcaaaacataagacaatatctgttttgtaaaagcatctaaaattgtagacagatagcaaaatacaccattataagggatatatgttatatctgtcagcagtacccttctcgctccataagctgtgaattgtctttttaccagattgtctgcgacatgattggtctttattgcttttgccattcttctatatggatttgcagctcttattttacacacaagtccatactttttcatcaatcggcggatcttctttacattcataattatgggtggattttgatgtatcagcgtcatatagatgctctttgcgcccttatcatatccacgtttagcatacgctccaagaattatttcaaaatctgcctgatcttttaattccttcctctgtctttcatctgcggcccctgcccagcgatagtatcccgatcttgatactcctgctatatcgcaaagcattgtaactgataacagattatcttctttgcttactaatccgtatataatctcaaatttacagtccgattcattcatcatccgtctttctgctttgagttgtctgcttttataattttttttttaaaaactcaacctcctgacgaaggtatagcagctcatgctgcatctgatctaaggatacttctttttcatgatttgagtttattcgtttcatgggaactcttttggttcgattttctccctctgtaaatccatctccagatagcgcctgcttctttactctctgcacaatgctgtctatctgtttttgttgaaacagcttagtgtcataacctaaatcagctataatctttctcggggcatctccagcctggtatcgtatccagaaatcctctttaaacctggctgtgaaatacagtttgttctttgtgacattcagggtatacttattttccttaagttgcttcatctggtttactgtgtattcccgcatatctttctcctttagatgtttttattatatatcaacatctatcagagataaagaacccccttttcaatctgtccactttggagggggcatcccttcttcatagtgtccattttcaaggaacccttcttcttaatgtgtccacatctatgggtacattataatatcacaaactccgcttttccttctgcttttccctctgcttttccctccgctttcccggtttctctgcctacactgaattcatcggcacggatttttttcatttcttcctcttcattgtattcaaatatcgacatcgctataacctccgctctctgcgcgatcaaaaaatccgccagtatgtcatttcggatacattccgtcaccgcacgctctactgcttcccctatatccatctgttccgcatattttcggatacattccacaaacatacagtattccctgagcgttctgcatttctccatcagctcccggttatttccgggattgatgttcagcatcgtcaccgtcacttccagttcgggggaggacaccttcttttcaaacgcatcggacagtcttaacacccttctttccggctgttcctgcgtcccattatagaataccacgaagcggggaaccggtatctgcaccagcttactggaatagagtgtcttccctatcacatacttttccaactgcctggcaatgtaaaagagatcccgaagcggcatattcggattaacggaagactgatgctcatataaactcatttccgaatcaaacaggaacgatacatcattcttaaatcccatatagattgcattttccagtgtacagatttccaaatcgccggtgttttcgtatacggttccatttagggcattgtatagttccaagagtttttccctgtcattatacagcatacagaaaaccgtatccttgtgtttttttaccacatgaagttctttttcttccatagattgctttttccgtggaatgtttttttccatggagtgctttgcttccatagaatgctttgcttccacagactgctcctttctgcaattgtgtgcaggaagccgtctgatagaataagggcataatcaccttccgttcagcagctcctgcttgtttaaaatggattgtaagcatagagtttctgaatagaatagagaaaacagatggcgtataagcccggattcatagaaaattatgcttgtatttactttagcatgttattacccatactgcaacaacaaatctacattttaatatcttctgaaaggcaaaaaaagtacttcatcaaagcaagaccgccgcatgccattgttccggtcactgcggcggtttatcgaatttcctgttaatggcaatgattcctgtttttcctgcctaatctgttctttttctcaattcctcttcattctgccaatgttttccggcagtgttttatccctgttgcattcgcggataacctctatttcttctctgtcataaggtctgaaatcctcatggaaaatatcatgcatccaaagggaggtgtcgatatccggcagctttttgataaattcccacacataattaaactggctctttccattgacaaagccgaagaaatagctacccactccttcttttttccacatgggcagatgggtctgtatcaggcttcggaaggggcggtgcagccattccgtattgatcagcggacggttgaaccggcgcaggaactcaacgtattgtctggaatgggtataatcaccatagtaatggaaggtgatgatatccgaaagcgctatggaatgctcttctatttccgcataaattccgggctttttcagccagccgtaaggattgtcggcaccggctccccatacgtccgctgtcaggggctgcatcacattcgcctcacgcagccaggtaaatacgacctccatcatgggcagggagcgggacagcctgccggaattgccggcttcattccatacattccacatcagaatccggggatcctgtccgtaccgcgaagccagttcttttatatattcctcaattacaggccggttttcgggatcgtcggtgatgctgtagcctatactttccccggactgtgtgctgtcgtcaaagggtgtcacggggcttcccccgaaataaccgggaaccggttccggctgcggccccaggcgcggcgtcctgtacttttcccggggcacacagcagtcaccgaaaagcacgggcatcaacgtaatatcatattcccccagcagttccaggaattcatccatatggcggaaaaaagcttccttttcctgcctgtatacctcaaagggcagaaccattcggatactgttaaagccaagctccgctgccagcgcaatttcccttgcggcgtcccggaaggcttctttatggccgtattcctggaacagccagagactcccggtcatggaaccgctggggataaaattaaacccggaaatccatggacgggcagtataccacgcccatgcttcttcctccgtccatcttctcttcattcgcagcccctcctttcttctctccgcatgtcacaaaagctggcacttttcctgcagcagaagagcgagttcataagccagcttcctggcttccctctcatcccctgcttttcggatacgtgctatgcgtgccgtaggcggatcatacataggaaccagttcgcaggcttccagcaggttggcgcagaattccgcagcctccagtacctcgtcaagggatttccttcccgcccggaaaacctttgttttttccgacaaagcttcctgtaccatggccacaccgcgctgtgcatatccttccttattcgcattgggaaataccattccctcatccctttttctgcgaaagcccaggacggccgcaggaatggaagggtcccggaccgttccgtcgggataaaaaattccatgtacatccgaccagtaaccggtaatcatcagttcaaacaaataccagccggtatgatgctcccggcagatgtccagggccagatcataaggattggcacggcagagacagcacagttcactgttgagaaagggtttccctgttcttacagacagttcttcggcagccaggtagctttcttcgatttgcctgcgcacaggaagataatcatgaaagctgaaaacatccacctcaccgatcgtatcttccacgtcgctcatataggtatggccgatggtaaccgcattcacattatccagccttctgaccttatcgcagcttcggcgcaggaattcatttaccttttcccagcgggctttccgttcctctccttccgcttccaaaatatagtcgttgcaggagggttcattcattacatcccacatgatcagccccggctctcccctcagagcctgaaccacatctttcacatatctgtctgcatattcctcatatccctgttccaaatctcccggatccaatccatttccattgaagagaataggcatggtactgatgccggcttcccatgccgtttccacaaaggaacaaagcttttttaaaaagtcccctggagctttcctgtattcccgttccgacagccagattctggtgctgttaagccgcaggctccccgcatatcccagttcccttttcagctgttcctccggaacccggtatcctcctgaatagcaaaaacctctgatatcactgtaatcttccaacggtttcatctgattcccccttttctttcccatatgcctttttatgtaatgacagcaatctcattctttccctttcatattacccttttacgcttcccattaccaacccctttgtaaaatatttctgcataaacggatagatgcaaagcatgggcagcgccgctataaaaagttgggccgcctgataagtatccgtcccgatggaggccattttcatctgctcctccgcggaaaggctttccatatccacattcagcaccgtagcctggagataactcatcaatggatattgggacggcgtcttcatataaataatgccgttaaaccattcattccactgggccaggctgcagtaaacagctatggtagccagcgccggtgtggcaagcggaagaaaaatcctgacaaggatggtccactgccctgcgccgtccagcagggcggcctcctccagttcctccggaagcccgcggaaaaaattcagcagcagcatgacataaaataccgtaactgccgacggcagaatcagcgcccacagacttccgataagcccaagcctgctgattatcatataggtgggaatcaatccgccgtttatcagcatggggataaaaaagtaccaggcaaaaatacttcgtccataaaacttcccgggacttttggacagcggataagctgaaaggacagttaaacaaagcgtcagtacaagcgagagcgccgtccgcgtgatggaaatccccatggatttccagaaggccttatagctgagcagatattcataggtagccgtggtgaattttttcggccagaaggtcacattccctgccactacctgggcattatcgcttaaggataccgccagcatgtaaatcatgggcgccaggcagaacagggccactgctgtcagaaagatgctgttgattatattaaatattttttctccctttgaaataggcatggctgttcctccttagaaaatccggtaacccgcaaatttataagcgctgtaataagaggttcccacaagcagcatggataccatggatttaaaaatgcctatcgccgtcgacagtgagtaattggcattgaccagacctatccggtataccagagtgtcaagcacatcaccggtcttatagaccgtagggctgtacagattgaaaatctggtcaaagttggcattcatcaccgaacctatatttaaaagcagcatcagcatgatgataggcagcattccgggaagcgtaatgtggatgatctgctgaagccggttggctccgtccatcaccgccgattcatagaggctgggatcgatggacgttatggcagccaggtaaacaattgtgttaaagccgaactccttccagatatccgtcactatcatggttccctggaaaaaacggttatcccccaaaaagaaagccggctggccgccaaaggccataataagcttgttgacgatacctgtggatggggaaagaatatcaatcagcaccccggaaagtataatccatgacaggaagtgcggcagatatacaatcgtctgcacggttcttttcagccttgaatttcttatttcatttatcagtatggaaaaaagaatggcaataaggattcccaaagccagcttccccagggaaatcatcagtgtattgcgcagcgccctaataaaatccggatatttggaaatatactgaaaccagtaaagccccacccatttctgatctccgaacagtcctttggccggtatgaatttctgaaaagcaatcttccagccatagaggggcagatagttaaaaataaagagcagtaccatgccgggcagcagcatcagataaaagggcgcactctgcttcagacgctgcgcaggccggcgtttcataattataatgttcttttgttccttcatgctatgcctccttggaatgcgttgactgcatgctgtcccgaacggcgtatattgccgccgcccgggcgctcatatttcttattgtccgctcatgctttcatgccattcgttgatttcctgggtgatcatttcccctcccagcacattccactgttccacaaaggaatcaaattcatccacgggcgactgtccggtaatgatgttggtaaaggtctggatttccaaatcctcaagtacggcctggttttctatcatggattccgatacgaaggatccccgaagatcgctggtcaggttatttttctctttctgatccagggcatacataaaggtctgtccgcaaagcctgtaggtaaactgccaggatgccgcacttatggagggttctccgaagttgtcggtcattttggatccatcctcggcaaaacgctgcatggcataaaactgatcctttgccagatagttgctgtctatccaggtggtgtccccgtcctccatggcctggaaccagtgctcccatctgtctatgtttccatgctccgtttccgggctgtagagacggtaagaatcattattccacatattttcccattcttcataggatatggccagctccggatacccttccggacctgtttcctgaggtcccagccccatgaaatgcatatagttgcagatttttgccacggcctccgggttggcgaagtccttattcaccaccagccattggctgctgtaatcatatacaacgggtgaggtttcttttccatccacggaagggatggggtaaatcttccactccagggaatccggatccgcagaattttcatacagcgactggagacagcttcccatcaggcctgtccactgaatgccgaacatggcccccagctgttccttggtcaccagctccgcttccgtatcatagtcctttacgatgaattccggatcgatcaggccgtccttgtaatattgggcaagcttttccagcaccggcttcatctccggctgtacgcttccgtatactatattgccgtccgccccctggatccaggcattgggatacgcgccgaacgcattggcaatactggtcgcttcaaatcccgtatcccagattttctttgtcaggcctatgccgaattcatcctttatcccatttccgttggggtccccatcggcaaaggcataaatcattttttcgaaattttcccaggtgtcgggttccggcaggtcattgtcctttctccatttttcattcacaaaaagggcatggcaggtttcaatcctgggctgtacccagggaatgccgtacagctctccatccacggttgctgcgtcaaaaggaaatgtcccgtcctttgtcatggcctcctttgcctgatccgtcacataaccgtcatacacatcagtaaggggctgaagcagtcctgcctctatcatctgatgcatctgtgtcagggatacattcatcacatcaggcagatccccgctggccagcatcagattcactctctcgtcatactgttcctttgccgccagaaatacatattcgatatcgatattaaacagttctcccatcttggcgctccagagactgttctcataatccgtagccgatgcggtagtggcaatgcttgtcatggctgtcatcttcaccggttcttcgtattttccaaagggatctcccttttccgccggctctttagcctcctgtgccgtctcagcctgtgttccggcggcagccggagccgtgctttccccggtatctttgccgccgctcccgcagcccgcctgggataataccagaatggcggacatagccagggcaagtaaggatgtcattttactttttctcataaatagtcctctcctttttcttttggttatattattaatcaagcaggcttccgaaagccctggataccggcgctttcagccggataacttccctgtagtcatcggatgcatccgcagccaggaaggaaagcatgccttctccctcccaccctgccggtgcatacctctccaaatccaggatatcctccgcttcctccgccagataatcggcgggccgtttcgttcccctgccaaattcctccccggaaggctcttcttccagggaaggctctgcttccagggaactcttcgcttccatgatgccgccgaacctgacggcgctgacatactccgaagtataataatccatgcggacagccagatccgcttttcctgatattctgttcctgacaatcttaagcctgccgcctgccccctgtattttcagggatactgttgtcagctttcctccgcagccgtttgccccgaggaacacgcagccgctgtccgcatcgtaatctgcatagcatcttttccaccggtccggataatagtgcaggatctgaccgatacaaagtcccggattcaccgtcattttccccaaaccgggcatatttccttccatatatattacatcggaaatacccagcagaattccgctcagcctgacttcacctccgcttaccggcaggctcatataccgccggagccgcagccccggatcccgggccagcccgtccaggaacagcgaatccacaatacacacatccacctggctaaacccgtctggaatcccggaaatgctttcagacaattccaccacttcatccgatttgttccagactatcgcagaaaaacgctgttcatccgccgaagccatgcagcccagcctgtcatcacagctgctttccacccgtcctgccggcatcctggcataaagctcaaaggcaaaataaccgggccggagcctgcccagatgatccaccagccccagtgcatccacaccggaatccagcatctgcgcccaatgcaccagttccacatccgtctcttccagaaaatcctctattacagtcaggatttgcggcagaagatcttgctgttccaggattgtcttccgatagggccacggaggcggcaccgtattcatttcattcacgtggataccgacatggttaaaatattctcttctgcccagcacactccgcatcatcctgagacgctccagataaatcttttcccggaacccataggtatgaaaagagaaaaagtccatgggcagatcttttctctgtatgtaatccaggaaacgggaggcattatccctgcattcggaaggaggaaggacaaaagcttctgccggccctcccaccagagcctccggatccccgtccctgattcccaaagccccatattcatataaggtttggtaatcctccggtgttccgtcaaaaaaagcgcccggattcaccggttcattataaatttcctggtaacccagcggagaacccatctgtttgaaatgagcggcaaaatccttcatgatttcccggtacttctcccagtcagccggaacactgcggaaattcccgccttccggctgaaccggcagaggaacatagcaccaggaaaaataaggcgatactccatttttttccagcactttcacaagccgatccgctttctcccaactgtaatggagcccctccggtgtttcctcaaccatactgccgaattccgcggccggttctccgataaataaatccatgcgcagagatgatatccggcagcgtctgaataatgcagcatccctgcaggttcgttctgccggtacgaacccggaatcaaacatggcaaactttttgaaaagaggcactccgccctctcccgccaggtccacccacacatttcccttccccatagccctcctctttcttactcattacgtaagttatcatcaaaaaaaattcttccggccaattccggagagagctccaatgccgacgcaagcttcagcatgatgtcaaaagaaggcagacttctcccctctaatacaggtaaaagcatatccctgttaactccgcttatttcggaaagctcctccacagaacggattcctctcctctctgcctgatcccgcaggatcataacgttcactttatacgtcatactcatgctgctcctccagaacttacttattacgtattaatagtatcatagtatctattctgatgtcaattaattctttcgatatcgttccgatttcttttgaaatacattttcattttagaattatttgtttcttttctcgcatttattgctttctgcgtaagtttatgttatattgtttatatatttcgcgtcctttttcccaaacatacacggaatgccctgacggactaaaacaaacgattaattataaaatggtgatatcatgaatccttcttccaaaaataataactccgataatgttaattccaagaatgttaattctttgctttgcgcccgtatgaaagagcgccgaaccatgctcaatctgacattaaagcaaatcgcggaagccctgcacatcacagaggccaccgcccagagatatgaatgcggagaaatcaaaaatattccttatgaaaaaattgtaatgttggcagagattctccaatgctcccctccgtatcttctcggctgggaatatctgaaggatcttcctcctgaagtggagcgtattctcaattattataaccagctgaatgaggacgggaaaaaagaagcggaaaaacagctcgataacctgactctcatccctaaatatacggaaacagataaataacaaaaaaggcgggaaaacggacgcgggctcactctcctttgagtgttccgcgccgtcttcccgccctttctctcttgccataccggttatttccttttaaaatccaatttcttcccttctccgtctgaaatatgccatttgctcttcatatcccggctctctgccaaaatctctgttttcctccggatccttttccaaatcaaacagcagttccgaaccgtcgtctccataataatgatatttcaaattcccgttttttatcatcaggttacgtccgccccattgggatatggtctcatccagccagtcttcgccgcgaccttccagaagccccgtcagactccggctttccagcccctcaggagccggactgccgcaaagctcgcaaagagtggcataaatatcaatcaggttcacgtttttacggcaccggcccggcgcaaaacgccgaggataccggataaagaaaggaacacggacgctcccttcataaaaacgctgtttctcccaaatagaatgttctcccagcatttccccgtgatcggaagtatacaggatgatccagtcatcaaggttttctcccgcctcctccagataatgaagtatccggccaaactgggtatccacggtttccacattggcataataggccgccatggcgcgcttcacctcccgcatcgtcacctcctcgccgattaccagcgggggacaattggaacagcgccccaaaaagggatgggaggatggagccgtattcgtatagggctccacacgattcagataataatcaaacaattcctgtgaagcaatatagggataatggggattccgaagccccacatacagcatcagaggttcctctcttttgggtctgtcataaaagctgtccacaaaatatccatggataaaattccggcagccctccactgtcagcctgtcctccctggcatgtaccggatcgccgggccccgcccgcagaatttcctttttatcatcccacttcaaacgggaatcgaaccgatagactgcctccccgtcccccgactgtttcctgtaatagctgaccgcaacctccgtatctccggctatccggtacctccagccctgcatctgatccagcccgagatgatgaagctttccgcaggccgccgtctgatatccgtgctcactgaatattctggcaaaggtacggtaattcggctccaaatcctccccgaagctttccacgccgcatgtacgcggatactgccccgccgccatacactgccgcgcagggatacataccggtgaaggagtataggcattgtcaaaaatcacggccccctctgccagacgatccaggttcggtgtgcgtaccaccgtattccgggcaaacccgcagacatcataacgatgctcatcactcatcaatatcagtacattcggtctttccacttatctccctgcctttcccggaccaatccaaacacccactaatactgaaggacctccccctccgcacattccggcgtgaataccataagcttcccataggactcatatccgccagccgtaaatatatccacctcactgatcagctcctgatggcatactatcaccacatactcagccccatttttcacaatccgtatggcttccgcctcttccccggaaagcgtccggccatttctgaccatggaaaccggaagaagctccgcggaaagctccagtcgctcttttgccccggcagccgccaccacagtaaactgagaagtaaaaccggaagcctcccacgtattttccacacaaaagctttccgacagctgattatactctgtggatatctccgcctttgtcacacagcacttccccttaaggcacagcatccttgcctgcactcccggggaatgaaaccagataccgccgtcctcaggctccgcaatcccctgttttccaaaatggaaacgggactgatagctgtgaacagccgccttccccctatttccggccgcatcccccgcctgctgaccttcctgtccctgctgcccgcaggaataaaaagcatcacacagcagaataagcccctttgccagcaaaacagccttgcgcacgggaaacacccctctatccagatacccaagatgagcgcccgacaccattcccacccccggaaggaaacagtattcccccttccagggcagggccatacggctgtagccccagctatccacacactcacagaaattttcgccgtctatacacaccgtattatgagcggcaggctccttcagacgcttgcggatatcattatccacataagtataccgcccggcatccacaagaatatcctctccatgagaaaaataatccacatgaagctgatcgccgtgcccatgcccgctccccatacatccgcagtgaaacctcagataatccgaatccgctcccaaaccatccctcaaaaaataatttccgctgtccgtcagcgcccgtgacgcctcctccggctccctggcctccagtccgtcataaaaagccttctcctcccagctcaaattccaaagattatcctccagcaatacctcatgggccaggaacttcagcctgccgtccttaaaaagcacagcgccctccgcgatcaaatcccgcgcatcaatatcatcactgtccccatgacagggcatatgcccgtcaggcttacaccaggccgccagagcataaaccattttccgtaccttctcccaaagcctgcgcggcgtcggcctgtcaaaacgcttcagatgcagcagactgtccagaagacagtacaacacctccccatgatacataggactctgctcccactgcgttccgtcccggaaaacctgcagatgactttcttcatccagacgcctcaccgcctcctgaatccagccattttccccgaaataaagccccagaagcagcagcccatgattctgaagaatcccccagttgctcagccggtgaaaaggaagattcacctccagcagataccccgcatgctcacgcagacaagcctccatcctttcccggatttcctccgtaaaaagaggacagttatcaaacaaagccatacttttcagccagaactcaacccgaatccccgcttccagactgcgccacgtcccattcctgctttccggagcaagcggagcatttaccagccaatcctccaaaagcgccacaaactttttcccatattccagcgccttactccgccctgcttcatccttctccccgcacctataccgccacgccttccccagaatcagaaaacaagtatgcctgttcaacgcataaagccattccggatccccgaacggaaccgcatcccattcaattttatccccaaaaaccacagcctcatgcgtccgctccatctcccaatgctcctgaaaaacaaaactattcttcagaatacgctccgcctgctccagacaagcctctttccccccgggaaaatacctcccgcaatccccagccacttcctccaaatgatcattacaccaaaacttctccaaattcctcataactccatcctcccaaaactttcctcatcatacaccacccaccccaccacctacattctctcacaacttccgcccccttactaccctaattttcccaccctcctcattatcctgcttctttcgtccccctgcttctttcattgttctgtttctttcattatcctgcttctttcattatcctgcttccttcatcatcttgtttctttcatcgtcttactttttttcatcatcttgcctttttcattgtacaaccgccttcattattccccccattatcacgctctctttatcatcttccctatcctcataccacaatatacaaaaagcgcatttgaatctccgaacccccacagttcatcctcaaacacgccctttccaatacctgcgcaacattccgtccccctttccgcccgcagaggctatgtgctgcctgcccggaccggaggtcccccttcgttccacagccagccccggctatgctgaggatcctgtaaggggcgtcataaacacgccggtccttaggctgcgtcctctgcagccttagtaccgctgcgtgtttatccgagcgaaagcgtcccctgcaaggacctcagtatagccggggccggctgcggaacgaagggggacctccggtccgggcaggcagcacatagcctctgcgggcggaaagggggacggaatgttccccactaccccttaatcccactggatgcaatcccctgcacgaaaaatttctgtccgcccaggaaaataatcagcaccggaatcaaagacagcacactcgccgccattaccagtccgtattccgtagaatactgaccgataaacattttgattcccagctggattgtcttttttgaagtactgttaaaataaatcagcggccccatataatcattccatattgccacaaagctgaaaatagtcatcgtggcaatactgggtttggaaagcggcagcgcgatacggaaataattgccgtattcgctcaggccgtctatccttcccgcctccagcagttcattaggaagggacatgaaaaactgtctcatcaggaaaacgccgaaggccgtaaagctctgcatcagcacatagcctgtatgggtatccaccagatggaatttattcatcatgctgtactggggcagcatatatacctgccagggaatggcgatagtcgccacatagcacaaaaacagcacatcgcgccctttgaatttacatttggaaaatccataagccgcaaagctggaggtgataacctggataaacgtgattatcacagtcagcttaaccgtgttgaaggtaaaggtggcaagcggtattttactccatattttcacgtaattattccactggaacaccgcaggtatccaacggaaattggcgctgaatacctccgtattcgtcttcagcgaagcgctcagcatccacagcagaggcattaaggtggctgccgtcaggataattaataagatataactgattatttttaccagcgtctgttttctcgctctcgtcatttcattcctcacatttccgccgcacacaaaacggcgctgttattatccgcatcttcctacatgtaactcacccattttttctccatccgaaactgcagtattgtcagcagccctaaaatgaggaacaggatcatggcagccgcgctgctttccccataattccaggcgataaaagccctgttataaatgtactggctcatcatggtggaagcattgcccggcccgccttccgtcatcagatataccaaatcaaatactttgaaggaattgatggtaagcatcatgaccacgaaaaatgtgctgggagtcagcatcggaagggtgatgccccggaaacactgcatggaattcgctccgtctatgcgggctgcttcatacaaggactccgggatatcctggagagccgcaagataaacaatcataaaatatcccatgttcttccatatgttcacaatgatgagagccggaatgacccaggcggtgcttgctgtccagccgggagggttcgccaccccaagcgcccttaaaatagagttgatcggcccgatatcacgaaacagggaattccataccgcagccaccgcaaccgtggaagccacataagggaaaaagatggcgcagcggaaaattccctttcccttcagtctctgattcagaagaatcgccagaccaagggatgcgcacatggaaaagaatacggtaaacgcgctgaaatacagggttttccagatagatccccggaatacccggtctttgaagatagcgacgaaattgtcaagtcctgcaaacttcatagggttgaaaccgtcccagtctgcaaaactgagcatcagcgaaaaggccaccggtatcataacaaagataaaaaatcctatgaaatttggcagtatgaaggacagtcccaccagtgtatttctccggttcagggacattttctttttacttttgcctgatgctgccatagtcatacctcattttcctttttgaaagggagacggcaccatttccctgccgcctccccgcgttgatttgctgtaactgtttcgtatcttcgcagatatgatttctttacaaattacttgccctgaatttccttgcttctttcgcccatttccgccaggccgtcatcaattgacaattccttaatcataatcaggctgtgttcctcgccaagcatctggtttacttctgcggaatgtacttcgagcggacgatccatggcaacatgtttggtctgaagagcttcttccagtccttccggcataccatccagagcagccagggctttgatggtatccgcgttcattcttgcgggaatcatgccgcagtcagcataaatctttgcgccttcttcgccgctgcagtattttacgaattcccatgctgcgtccttatttttggagctggcgcttacacccataggagttgtggatccaaccgtccatccggcttccactccatcgggatgaggcagtgtggctacaccccagttcacgcttgtttctcctgcttttgtcttttctatcatagtgctcatgaaccagctgcccataggcatcatagcgcactggccttccatgaatacgctggaataatggatatttccggttttcagtgtggagtaatccataacggttccttcgtcctgcatgcgcagagccatttcataataaggcttcataaagctgtaatccgtatcgaggatagtatgcttgccgtcctgaacagcccagttctgtacgcatgcctgccaggtatggaaaagagcgccgtatttcttgtcattgccttcgccgctggtcacttttttagccagctcctcaaattccgtccaggtcatgtcatttccgggataatccactcctgccgcgtcaaaaatatccttattatagtaaagtacatagaaaccggtactcaccggcagcgctacctgcttgccgtccagcttcagggcgtccgatccgttcattgccgcaatatccacgccgtctttttctatataaggagtcagatcttcaagctgtcctctttctgcgatggaaggcgtattgtcaggatcctttacccaaaccacgtccaaatcattcccgccgttcagcataacagtcagcttattggaatattcaccggatgcgatatcaatcagttctaccttaatattgggatttgccgcctcaaatccatccaccagcatctgtgtggaaggctccgtataagaatcccagtgtgcaaccttaatggtcacctgctcgccgcttgcagcgggtgtttcctctgcaggcgtgctctcctgtaccgctgaagattccgcagccggtgtttccggcgccggcgtcgtgtccgcaggagcgtttgccgcattgtttccgcatccaaccagcatgcctcccagcattgccgctgtcagtgccattgccataaattttccggtttgtttctttttcataatctgtaaaactcctttcccctttttcatatcagcaactatttgataatgccattataactatcttttttatcccccgatactcacattctcactaataaataataattttttaaaaaataacgttttcagggcaaaatgcactaatactattttcgaatgtaataattttttcgaaaaacacacaactatacgccttctcttttagatatatgatataattgtaaatgtgtatcccgctctccgcctgcgttcccttgccgaaccgggcctcccttctctctgccgcaggctccggccatgcagaggatcctgtaaggggcgtataaatacgccggtccttaggttgtgtcctttacaaccttagtaccgctgcgtatttatccgagcgagagcgtcccctttaaggacctctgcatggccggagcctgcggcagagagaagggaggccccgatcggcaagggaacgcagccgcagcaggcggagagtgggatacacattcacacacaataacaggaaacagcaacgggagtcttttcatgaagaataagctaaaagacagcataaccataaaaattctattcgccatgtgtatttgtatcgtttcctttactctggtgagcagcctggtcatctccgctctgctgggaagccggctttcggagcgggcaaggcagacgaatgagcagtatctgattacaatccgaaatcagctcaacggatatatcggcgaactgaataccctgggagccctgtgcgcaagcaaccagaatatcacgcaggcgctgggctaccatactctgaataacgtttctgccaagcggatgtgcctgaaggcccaggaagcgctggacagctatctttcttccagctcactcaccctgtatgccacccgccttgccatttttaattcggataatatctgtattactgcctccgcatcaaaaggacataatatttccgaaaccgagcagctgcaggaatatgccgccgcctgttttcagaacggaaccggaacgcccgtttattcctggcgctctgccattcccaacgtatccgcttccgctctcacctcttcaaccgataaggattccatcatcctggcctgcctgtaccctctttccgtttccgacggttattatctttatatggaaatcaaaccggagcttctgaaaagcccgctggccccttaccaggatctgcagcagattttcatcactaacgaagaccggagcatattttattcctcttttacgccttccgctgatttttacggggaactttccgatctgacagacggcatcaccctgcagacaggcggacgaaaatatgaactgtcttcctgccgtatcccggagttcgggatttatttgtgcatactcagtgacaaaaccctgtttgccggggataacctgtatatcctttacctgctcggcattatcctgatcaccactataagcgccggactgattatcacccggattgtcagtaccagaattacaaaacccatccatgtactgaccgcccatatccgcaaaatctccgaaaccgatgatttttcctacaatccggacatcgtaacctcttccgatgaaatcggtgaaatcggccatgccgtcaatcatatggcgctgcacatccaggagcttctgacggaaatggaaaaaatgttcgagcagcgtaagaacattgaaatatccctgctgcagagccagatcaatccccatttcctttataataccctggattccatccgctggatggcagtcatccagaagagtaaaaatatcgaacttaccaccagggccctggaaaacctcctgcgcaacgtggccaaaggcgtcggggataaaataacgcttcaggaggagctttccctggtacaggactatgtccatatccagaaggtgcggtacgtggaggtatttgacattcattatgatataccggaggaatttctttcctgcaaaatcatcaagtttactctgcagccgattgtggaaaatgccgttttccacggcattgaaccgaccggagaattcggggaaatcgacatccgcgcccggtcggacggcgaaggcctgtatctgaccatagaggacaacggcgccggcatgactcctgaggagctgcagtctctgaaggaaagcctgaaaaacagcaacaaggattccctcagcggaataggcgtcgccaatgttgacgcccgcctgaagctcaattacgggccgcagtacgggcttctgtacgacagcatgcccggggaattcacccgggttaccatacatatcccgctggagcgggactgaggaaatatggagaggagcaattatgtacaattgtttaatcgtggacgatgaaaccattatcttgtccggaatcaaattcttaattgactgggaaaaaaatgactgtgccatcatggatacggcgagaaacggaagggatgccctggaaaaaatccgtttctgtccgccggacatcgttttatgtgatattaacatgcccgtcctgaacgggatggagctgcttaaaatatgcaatgaagaattcccttccatcgtctttgtgatgcttaccaatcttcaggaatttgacctggcccgggacgccatccgttaccgtgccgccgattatctgctgaaggtgcagctggaggccccggccctggaggaaagcctgcagaaggcaaaaaaggaatatgaacggcgcagtaagctggcagaggcggatcggatgcatttttatgatgaaaaaaaagcacgggaactcgtccgggatgcctgcctggaaatccttttttcaccggatgaagaagccctgaagcgagccggagaggtgcttgataaaaatcatatgctcgagggctatggactggtgtacattccctttgattacagtgaggttcccaacgcggaaagactggatgcggaggcccgcagggagcttaccgcgtgggaaaaggaactggcgacgcgtctgtgtgagacggttttcggctcctcctgcctttttatctccaccggtcagacggactgtctcactctgtttatctggcatcaggggaaggaatgggaatcccgcatggccctgttttcctccaagttctcctctgcttcccggaatatcacccaggccctgccttccatcctggttaccggctgtttttacggaaaagaacagctttcagcctgccggaatgaatatttcagtctgatccagtatttttacctggatgagctcacttcttcccggaatctaaccggagaaccggccgtgtttgaaccgctgggactcgccggcatcggttcccagctggaaaacgagctgaatgcgaagaacctcaccggctgcaccctgctgttggatcgggccatacgaaggattcaggaaaccactcaccagaaaagccaggcgatatggctgtgcaatgaattataccgatgcgccgcaaaagcgctccaggacagcagtcttaacgataccaccggctatgcggaaattgaaaatctcatgacacgccgtcaggtcatcggatggattgagaaactcaaaaattccctgacagaaaccatctggcaggaagccaacttaaaatcggagcctgtggaaaaggcaaggcagtatgtactcagccatattgaagaccgcctcagccttcaggatgtggccgaagaggtatgcatttccccggggtatctgtccaccctgttcaaaaagcaatacagccagagctttgtcagcttcataaatcaggcgaaggtggagcatgcatgccggctgattcaggaacggaaatatctcatcagtgaaatttcctgccgtctgagctttgaaaatgcttattattttgccaaagttttcaaacggtatatgggaatgacgcccagcgaatatgaaaaatctctggaaatatccgccgctggcacacacgaaaaagcaggcaggaatacgtaagcatacgtttcctgcctgtttcctgttattccttcattctattttcggtatcctcatcaattttctctctcaaacgcaggagcttctcatcctcctgaaaatactttttcccatattccaggttaaattcataatcaaaatccggcggatttttcccctggttatgctgaataatggtttccgccttatcaagagcttttatcagctttgcttcaggagtggattcttcattgtattctttccacacccccaggaaatggcttttctgcggttccggaagcagggaaaacacgcggttgaccgcttcctcctctatccggtatttttcttccggatcgggaaggagcgccgcggaaatatccccctcatacaattctcccatatcatggagaagggccatttccaccagtttcaggcgatccagctccggatattcccaggccgcggtcatggcacacagggcaagacgccaggaatgctctgcggtgctctcctgtcttccctcactgctccatgctgtgcggagcacatttttgagccgctccgcctctctgataaaatgcagataactttccaatcgttccatcgctgctcccatctgaaaataccgctccggggccgcacagcctgccggcccggaacgcattttatagttgctctgtactgtttttgctatttccctttcttaccagagttgggcgtgcagattgcagaaatgcattttcaggcacactccaggactccttccggctgaatgcagcactaaggcatcaccctgtggatatctctgggaaaaagggccgcctgccgcacattctccagttccagaagccgggcggtaaaacgctccaggccaagtcccaggcctccgtgcggcggcattcccgctttatggatccataaatagctttcaaaaagggaaggatccattcccattcgttccattttggcaagctgctgccggaaatcgtggatgcgctggccgccggtggtcacttcaagcccgcggaacagcaggtcaaagcttaatgtcacctccggattttcttcatcttccatagcgtaaaagggtcttttggcgcttggataatgggtgacaaagacaaagtcgctccctgtttctttttttacgatttcgcagagcaacttctcttcctccggctcgaaatcatttttttcacaaagcgggcgattataccgggcggctatcaaatccttggcttcatgaaaacgtatggagggaatgctgccggcttccggaatacgtaccttaagcagggccagttctttttcataatgggactgaagccaggcaaggctgctctttatcatggcggcttccatccggcagatatcccggaagctgctgatatatcccatttcaaaatccacactggtatactcattcaggtgccttgccgtatcatgcttttccgcccggaagaccggtccgatttcaaatactctttcatacacccctaccatcatctgtttatagaactggggactttgggccaggtaagcatcctttccaaaataatccagccggaagatattcgctcccccttctgcgccctggtacacaattttaggcgtatggacctcggtaaattcttccttttccagaaaagcacggaatccgcggcacaggccttcctgtattttgaaaattgctcgctgcttttcattccgcagggtgagggggcggtaatccagcagtgtttccagggatgcatcaatcccttttccgttaatcaccacgggcatttcctcctccggtgcggaaagtacttcgagttcggtcaggtgaagctcccagccggttttggaacggggctcttccaccaccagggccctggcccgtatgcaggcttcttcttttaaggaaccttccacacggcatttaccggtatccagtacacactggatcagacgatccgatgtccggaggataaggaaggaaaagccgctcatcttacggattttatgaacgcttccgtggattgtgatttcccggttcagaccctcctgcggccggccttctgccggaaaattgttttcattatctgtcgggactgtttctgcctgtatggtttcaaatgctgtcatcatgaattcttctccttttttctgcccggaaatgctgacagccggtaaaagctgcatgaagcaggcggccggctttttctgccgcttccggtataacggaagctttccggggtgacaggatccttcgatccttatttttcagtaccgcttttgtaaggagaactaaaatccatctggacatcgtctttatgtctcattttaccacatcctttccctgagagataccaactgtcaggttcccggtacaggacaatccgctatccggcttttacagacaggtattcagcctgcccgaatggatatccggaaaaaacgatcaaaaagagcccgcaaaggtaacctgattaccagtgtggactcttatttctgaaatctatgccacacaggtacaacacggaaagcgtttgtacctgtgatgctaaggaactatcgggatagtccctttacatccgccgatacaaacgccgccgatcgtcgtccccgtaaagtttactgattacaacattcagcataacatttgcctttccggtatgaaacatacacatacctgcgattaatttttcttatattagcaccgcaggcatagggtgtcaacccctaacttacaccggggtgcagataaaaaagtgggcgctgccgtccctataaatcctttactgcggttaaatccgcatcttcatagcggttatggccaggcaaggcttttttatatttccagcaggcaatcgcctgctgcagggtcttgccgggattcgcctcaaaaaaatccctgatataggtattatactcaaactgcctgtcaataaccgtctttccctttttcttttcctccagaatctgataataagcttctatcgcctgggcataggtctttccggaattggttttcagccatttctgaaaggctaccggaaaagaaaagctgtttcctattttttctttgaaaaaagcacggtgtttttccgaacatacaaaatcaggctcaataattgtctgttccgtaattactcccacctctttcctggatttggatactttttttacagggtttattcttcccgtatcaaggtaacaggcgattctttctgtaatttcctccttgccgccggaagcgggcaggccgttctccctgcagaaggaaaccagctcttctttcaggtaatagtagctgcggaaggttgctgcatccagttttgctgataagtccgggcgttctgtcatttgtattctcctttcagaagcaggtaaatgcgccgtcaataataaaatcagagccagtggtaaaggtactcgtatcacctgccagatatacacagatggattccagctcttccggctttcccattctgccgagaggcgccatctcgttccacttttcaatcagaggcaccagtgtcggggaattcagcgtcagctccgttccgatatatcccggactgatactgttaacgcggacaccccgttttgcccattccaccgccagggatttggtcagctgtacaacggctgctttggaggcgttatatgcacactgcggctgcggcacgtttacgatgtgtgccgacatggaggcggtattgatgatggagcctccgccattggccagcatatattttcccgccgcaatatcggttaaaaagatgccgttcagattaacattgataaccttcagccactggtcataggtcatctcttccgccggcgcgttgatgcagatgcccgcgttgttatggcagaaatcaagcccacccaattctttcaccgcctgctgcaccattgcatccacctgctccttatcggtacagtctgtcttaatggcgattacttttctgcctgttttctccgcaatttcctttgcggtcttttccgcttcgtcaatgtcaatgtccacgatggcaatatcggcgcccgcttcagcaaatgccgacgccgtacattttccgataccccgtgcggccccggttacaaacccctttttcccatccagtctcattttctcgataatccccatagcttctctccttttctttttccgatcatttatgatttgttttatatctcatgatgccgaaatacgctcaggcctctttccggcagagcctgccccccagcagttcttccagctttgccgcgagcagggatgctatcacctcattccctttatcggagggatgaagaccgtcgtaggtaaaatcagccgcttcctccggatagggatattcatcttccccgaatcggaccggtatcttcgtatactccggatagggcagcttccgatagccgtcctgtgttttcacccatttgaaacgaaccacattttccggagtaattcccgataaatcatgcagattcaaagccggaatcccttcctcacagcaggtttcatagatgccctccgcaatgtccgaaagccattgcccctggtcgggcatatagctgccaagggcattgttaaagggatccagaatatagacgaaatccccccgttccaccggattcataaccaggagcgccgcattcggggccttctgccggatatgggaaatcaggatacccatatttcccaatatggttccttcttttttctgcacaaaatcttcttttctgcccagagggacaccgccatgccagtcattggttcccagaagaaccgtatataaatcagcctccggcagctctgcatttacccagtccggcgtggacgaaccgttcataccaatattgataacggataaattggaaaaatattcacaggttcgggtgagatatccctttttcacgcgattgtccgtttcatcaagatgatcattcagataggtaaaagaatcccctatggcacaccactttatttcttccttcattcctcttcttcctcctcccaaaaaagctcatcgagggtttttcccaacgccctgcagatgccgatgcacagctgcagagacggattgaattttcctgcttcaatcatcccgatggtctgtcttgttactccgaccgcctccgccagctgttcctgagaaaaatccttttcgatacgagcgattttcattcttttatttttcacccggattcctcctttattttcgaaatgctattccgtatattcttctgttattttctgctcctgcagtatttctttcccgtatgccttcgagaaaataaagggtgcaaataaaacagcgttcagcaccagcagaatgagcacatctccccatgcaattacctggccgctgataacatcggcgcttcccgccactacggcgattaaattattattcaggtagtgcatgataacgggcacccagatattgcgggtcttcatctgcgcatagccgaagaatatggcaagccccgtgcaggtgagcagctggctgacaacactctgcagccaggtatccgggctgtaataaaacatgttgatagggagatgccagaatccccacatgatgccaagcagcagcactcctgacctcttgccgaatctcttctgaagcatcggctgcaggaatccgcgccatccgtattcctctccgaaaaaggctgtgaatacaaggaagaaattaatgggaagggccatcatatttatccatacatatgaattttggaatagtttaaggaattcccccggctgcccggcaatcacatagcttaaaaagatacgcaggaaatacagtacgaggaaaaggaggacataaagccatggtcttcttttctgaccgtcgccaagactgagaccgtaatttcttctgacttcttttttatccattaaaaaggggatccataagagcaggcttccgataatgataatatactggattatcataacaaatggtatctccggaagtatcatactgattatggctgtcaccgtcataatgcctgtaaggattataaagctcgcataaaacttcattggcagcttttcttcttttttccgggttaaaatataggcaagcatcacacctgctgccggatagtacatctgtgcgttggggaacacactcacatcattccccctgtaaaagctgatgcccatcaggatccccattactatgggcatgccaaaggcaactgcaagaaaaatccagagctgctttttttctgctgcggttaatttgatctgcatctgtcatactcctccattccttatgttattggttatttgctgaaagctgattcttttctgccgggacggcaggaacagggaaggccccttgtaaataccctctcgggctgctatctatcgggggtaccttctcctgaattgtaattcaagattccatacccaggatcttgaatgggacttatagttatattacatggggaaaagagaagggtatggattctcttttgcaaagattgagactgactggaaagatgctctccttttctgctatactttgatctctggcagctggaaaggagtcgccatgtcaaagtttttatcatacgaagatcgtctgatcatatctcagcgtattcaggaaaacgcctcttttggggctattgcaaaggaactgggaaaagaccgcacaacgattgccaaggagatccggaaatattcctatgacaagaagagcggacgtccaggatacccctataatccatgtaagtaccgcaattcatgtaaagctaaaaaaatctgcggtgcgaatggatgcacgcatcagtcagcctataaatgcagcctgtgttcggaatgtacctttcattgccctgattttgaagaggacatctgttctgttaagaggaaaccaccttacgtttgcaacggctgccgtgctctcccccgatgcacccttttaaagaggatttatgatcctgcggacgcacacgaaatggcgcacaagactatttctgaatcaaggacagggattctgtcaaatgaatccgatatagccaggatcaataagctcattactccgctcgttaaaaacgggcagtccctccatcaaatctatacggagcatgtcgatgagctgatgtgcagtgaaaagacgttatataattatgtggacgctcagctttttgagatcaggaatatcgatctgccacgcaaggtaaagtatcgtccccgatacaaacagccggaatttaaagtagacagggggtgccgtctgggacgcagttatttggatttccaaaaatttcttgaaaaagaaccggagacaaccattgtgcaaatggatagcgtaatcggacggcccggaggaaaatgcctgctgacggttcattttgttgagaccagtttcatgctcgcttttctgagagattccaatacggctggttctgtcaaccgtatctttcaaacacttgaccgtattcttggagctaaggaatttaatcgtctgtttccggtgattctcacggataacggaagtgagttttccaatccaaaggagattgagtaccgggatacagtaccaatgcgtcgtacaaacgtcttttactgtgatccgagttgtccttatcaaaaaggcgcctgcgaagtcaatcatgaactaattcgccgtatcctgccgaaaggagaaagctttgatgatctgacccaggctgatatatccctgatgatgaaccacatcaactcttataaaagaaaaaagctgaacaaccgtagcccatacgatgcgttcagcttttactacggagaagatctgcttaagaaactagggtgttcgccggttgctgccgagaacgtcatcttaaagccgaaacttctcaaaaagtaacaaaaatcttgtgtgagctgccagaacaaaccagatcaaaaaaaggtaaaacgggatggattctccgaatacaaaaatttcgaacgggaattgattcttgattgtcatacacaagatcctgctgtacgcattataacatatcaaggtacaaatgaaaatacgggaaactcgcttgcaaaaggagaatttcgtttacaaagggggaaactcacttacaaaacaagattttcatttacaaaacgggaatcctggattgcaaacgggactctcgggctgctatttacccgggggtaccttcttatatacgcataatataatatatttttcttaatgtcaactatattttacaatttatatactatattttttatagtggtaaatagggattatatgataaaataggtcttaacaaaataaattttgcaaaaaattacaggatcttagaatctggttataaagcaccaagaaagttagaggagaaaacaatgaaaaaacaatcttcagtattattactagtgattatgatggtttcattttctgttacaggatgtagtgcggcagagtcattagaacatgaaagccaaatagaatccatctctcagatagaaactatgcaggaagattcaaatttcatgtcatcagtatttgatgatccggaatattcatatacccctaaccattcttaccaatcctatgttcgatacttgaatggtaccacttatacagctacgaacagaggcttgttcgagcaacgggatggttcctcaaagtgggtgcggttggattggggaaatgttattggtattggcgattttcttgacgatgatttgttttattctgtggggagcgaggtaaaaaagctttctacggaaaatgaacagatatcagctgtttatgaaggagaagatatcatcctgaaaattaccgctgaaaaaagagatacaggcagtcaaatatatctctcttaccaaagcggatatgtagaagggcttgtattggatacggaaggtaatgttaaagaagtactgagtatggaagaaaactaccgatatgaatccgaaaataagttatatgaaaaaaaattagagaatccggatagtgattttgatatgagtttatccagaagtgatattgatccgtgcttatccaggaaaacctatggaaaagaatactattcacggtggaattcaaatcagtccggcattaatataagaactttggtcagcatcgggtttgaaaacggcagggggatatctttagaacttacggatttttttgactcttgcatggtaacaccatggggaattgtgtattatgatgctgagaagcacggcgatatttatcttctttcccataaaggagaaaaaaagaagaagttatggggaagtgaaaacggcagcttttcgtttataaattatgatgaagaagatttatatggcatattagaaaaagatggggaacggtatataagccgaataaattttcaaagcggcgaatttgaaaacatacatacgttaaaggataagatagataaattcgatgtcctaaatggatggatatattattataatagcttggacatgattgaaagaagaaaaatcagttctccggaagagactgaggtaatcagtgaaaattaagagaaaggaaggcggcagttacacttgcgccttcctttttttgatttttatggtttccaatgatcttcggagaaaagaacaatcaactacgcggaagctcatgaaaggctactaaaaacagaatgatgtgaaaatcaaagacggtaccgaagtgaatgcaatcatgcgggatataatgtcggtcattctggaaggattgcatttcgatttacaattgagattccattttttcacgaactcacactgttatatcttttcagccctgttttccacaaaaatgccgtcaggaagccaaaacctgtaactacgccaataccataaacccacattttcacagagccttccccgcttatatacaaggtaggaaaggtagcgataattccataaggaaggataagataaaacaaaagcttataaatcccccggaaaactacgccgggtattttcatacacaaatcaatccccgcctcctccagacgtgtaatattgttggttgaaacgacaaaaaaggtaagtgatcggatgatgacctccatttcataccacagaataatcatcagaattacccaggcggcatatccggcggcaagctgcggcgtcaccttaataccgcacaggccgacgccgtaccacagaatacatatgctcaggagaaccagcggcagggaacccggatttacctgttcaaaggacagacgcagaagagggctgaccggtttggtcagatacaaatcaatatctccgcttctgattttatcggaaatattattcaccccaaaaaagtaaaccaccatatttaccgcatttaccagggaaaaagttccgataaagataaccatctccccttttccccaggggccaatagtttccacattggcataaatcgcctgaaaaaccatcaattccaccaggaacaaactgccatccacaaaaaacggaccccagaagcccagccggaacatcatcaaatgctggaaacgcaaacctatcagctcacaaacaaatttcagattattttgtattttatccttcatattcccactccgtcatatctcagtctgtatttttgataggttctgcggtttaacagctccataaaaatgcaccacaatgccagcacaagaacaccccgcagcgcctcgttcctgcagcgtccggtaaacagcatggacggcaggtaggtcacataataaaagggaagcacacgcatccaggctatcataccctccggaagcagcgtcagcggcacaatggttcctgttatcagggaaatcagattatcttttatcatcaggaatgtatttatttcttcaaaccgcagggtcagaagtcccagatagtaattcagctgtaccataaaaaccaggcccagaattaccataatcaccgcgcaggcaatcgtaaaaatgtcccttgtaaaagcaaatcgtatccggaaaataaatatccatacgacagcggcaagaaaatcgaacagcagatgaaaggcaaccacccccgtttccatagccagaaaatatttttctatattcaccggaattaccatatatttggaaaatgtgccattccggatcctggcgctgatctccctgctgattccgcctgacatttctatctgggacaaaaaggaactgataatgtaataggaaagcatactgtgaaaagtgaaaccggcgatcatatcctttccttcaaaaattgcgccccacaaaacataagcaaatataattttggtaactgtaaacagcatattgaagaccgtatctgcccgccagataagctgggctttgaaataaattaaggctgtttccgtgtatttacgcattggaatccctccttatttgcgaagcaaaatgcgatcctcctgacgagcagagggatttccctccttcccggtaaatccgttccaccacctttccgatttcttcctcttcgattgtcacatccaccggggccagttccagaagggttcccaggcattctcccgatttttccttaggaacttcgaacacctttttatatggggtgtcctccaataccctccagccgttctctttatgggtaaactgagtagggttatcgaagctcagagtaatctttttatttttctgataccggtcaaaaagctgttccgtagagccatcgtagattttacttccatggttcactaccatacagcggctgcagagggatttgatatcctccatgtaatgggaagtcagaaggatagtagtccctctttcctcattcacctccttcagaaatttccgcacctgtttgcctgccactgcatccaggcctatggtaggctcatccaggaaaaggattctgggattgtgcagcaaagctactatcagttccattttcatcctttctcccagggacagggtgcgtacctgcacatccatcagttccttgaccccgaacagctccacaaagtactccttgttttcctgatactgccgatccgaaagaccataaatctgtttaaacaaatgcaaagtatcctctgtggtcagttcaaagaaaagctggctcttctgccccattactacggcatactgccttttgaagtcattctccagtttattgggataatagcccatcacgctaatttcaccggcagtgggggcaatgatgccggtaagcattttaacgagagtggtttttcctgccccgttagggccgatcaggccaacaaacccgccctcttccacggcaaaatccatgccttttaccgcctctttttcttcatattccctgtggaacaggccttttatactgcctgacaggccttcctgttttttgtagcgtttgaatgtttttgttaattgagtggtttcaatgatattcattgacagctcctttccttttcctgcatgttttcgttgtgcaataaaaaaagcccgcaaaagtatctgccccgaaacggacatactgcttctgcgaactgtgattacagacagattcccaaaaagggacggttaaattccccgcgacagccaccgcaccggcccttacggacggcgaacctatcgtccgcagggctttggtggctgtttatgggaataaaaaaaacatgaccttataacgtcatgcttccgtaccgtctgttttctgttcagacatataaatgaagtgtatgaagtatttgcgtaaggcagatatccggcaaaagccggtcaaagggcatactgatagccagaaatggcttcaggccgtccttcttcaactattcagctgtaatctccttactgaacacacgcatgcacttacctcacttttttaattctgcatataataaaactgctgttttgatatacagcagttttattatatgcaggaatcatcaggttgtcaacggcaaagttaccacacccttaccctgttccccggtaaatggaaaattaccaaacaacctgacgtatcatctcgtactgatatgtatcaaaatacctgttccaaaatccccgtgcgtttggattggcagtaccatgttctacccacataaatgccgcaccttgttccagcacagatttttctgcataaaacaataaatcctgtgcaaggccggaccttctatactcaggaagcacatatacctcgcctacattaacggacttatcgcctgcacatacaaaagagttttcctcaccgttactctctataatgccaatcatttcccccgaatcatcatatgcagcgtatacagtcgtgttctcatccaaataaaacgcacgatatgtttcctctgtaaattcatcgcccttatagaaaacagggctttctttcaggtgatcaattatattttttgtaagagcccatatacaactccagttttccgttatctgactttttgtcagattttgaatacggtaaggtgtcgatttttcatggtcagcgcctgctttacgtatacagatttcagacattgttccaaactgcataaatgaaaacagttgtctggcgggaaaatcatgtgcgtaaatatgaacagaaaaattggttattccttccgcagcttcgttttgtgccatgtattggaacagttttcctatcatcttgtcctcatcttcagcacacgcgccgtatccacataccggaatatcgatatgtttttcaccgcatttattccatgtgtggtataaaagtacacctgtgatcctttcattctccattccgagaacaatttttgtatgagccaggtattggtctgtatatgattggaatttatccttactcatgtaatttaagaagggaaagtgtttcatctcctcctcatattttctatatagtatgctgataatttcctctttaaattttgccaggtctgaggctgtgtgaaatgctatatccattttactgctccttcgaattccggtctgtctctctgttttagtttgagtatagcatgtccgtttgaacaaagccatcgctcctccctatttatatgcataaatatttcctttctttgggacactatacagcaaataccgcaattggaggaatcatatgaataaagaacctgtttttttaactgacaaaaatcataccgtagtactggaagccctcaccggcgtaccgaatgcggccgtgcctgacagctgcaagccctttgaagtcctgacagccaatacatcggaaggtgctgcggaaaaacatctgccggtggtggaaatcaacggaaagcatatcacggttaaagtgggaagtattttccatcccatgacggaagagcacagcatcggctgggtgtgcctggtgacaaaggccggctgtaccatgcgtgtctgcctggacgcatcctgtgaaccggtggcacattttacactggaggatggggattcggtgaaggcggcttatgcgtattgtaatctgcatggattttggaagacagagatctgatttatacacagcgaagcaaacaggagatatctttatccacattcgcgggtaaaggtatctccttctatttaccggttgcttatacttatttccagatacttctcccgatattccgccggggactgacctgtccgtttcttaaatacggatgaaaaatattgttcgctccgatagcccacgcttctggaaatatagtgaacctttttcccttccctcaaaagcctctttgcttcctctatccggatatttgtcagataattcaaaaaagtggtactctcctcctttttaaataaactgcttaaataggatggatgaagccccactctgtcagccacggattcaaggtttacatcctccgcataatgctcactcaaatattcctttacttttttgacaatccctctgttttcttccgaatccttctttacctcagatgctttttgtttcaggccgctgtccttgctcccgcaccggataaggcatctctttatcatatcctcgaaccccttcttgtccaccggcttgagaaggtaaccgaaagcgccgaggttcacggccttctgggcatattcaaaccgattgtatccactgataaaaataacttcggtatcgatttttctcttccgcagttcatccagaaaatcgagtccgctcatggaaggcatgctgatatcgcataaaataatatcaggcgccagcctggcgatctctgcaagagctttctgtgcatctgtgaattcccccgtaattttacagtccaggctgccccattccaggatcctccacatctgttccagcatccatcgctcatcatcgatcaatacaatactatacattataaaatcccccctccttcggcactaatacgtccaagggctgcctttctgcctaaccgattcttatttttaaaaccacatagttttcatcaaactcaaagttcagtccgcattggccggagcacgctgttttcagcctgaaattaatattctgaagagttttcaccctttcctgtttccctacttcaaattctctttgaaccatatcattcagttcttttacctgttcctggctcagaatatttcccgtattttttatgataatcagcttttctgtttccgtttggagtgtcctgattattatgtccagtttttcctgtccggcacaggaaccgtggacaatacagttttcgatcagcggctgaaggaaaatatgaggaaccgggtattcatccagcgtatggtccagctcaaaaatagcagtaaacccttctccatatcttttcttcaaaagcaagaggtagctttgtatatattcgatttccttattcagcggaaccagatactgttctttctgcaggttataacggaacatccctgacaagagttcaatcagctccgtggtgttttccgccccttccttttccgcctcattaatgatcattcccagggtgttatacaggaaatgcggatttatctgactgtataaaagccggatttccatatccttacgaaggattttttcttcgtattctgtctgtatataggcatttatcttctgtatcatcacattcaggtaactctggagaaaaccgatttcattcttttcgtttacctgaattatgattcctctgtccccttctgaaaaccggttcagctgctccacaatattagtaatgcgtttggtcgatctggctgagtaaagataggaaataaagatggacaaaatcacggcaacaagcgctgaaaaaataaaaatccggatgagccgggcagataaatcaagcatatcctccctcggaatacaggtcacaatcttccattgggtgatttcggattcccgccagaccacatagtaatttttcccctgactcttataccagaaataattctgattactgttcagtttatctgtaaattctgtatccgccagaatcccctgacataaggattcgttattggaataaactctgttatcctgatccattaccatcatgaccgcggattcttcaaaattaccgttcataagatgggagcttaattcatcgatatcaacctctacggtaaccacaccaattcctttataggttttgaaatccactacctttctgctgatggttacaacttctttcccgctttccgccatgctttcatgtcttccctggatgtgaaccgccccgtttctgtccagggcctcccggaaccaccctccgtcctgatttttaataaaatgctgcaccggctggcgctgcagggaatacagatgctttccgtcgaggtcaaacatatagatcccgtagatttcaggatataaatcaatgatccctgcaagtcttgttttcaccgaataatagctgtcaatatactcggcgctgcctgtactgcgatcccgcagcacaatccggacatcatccgaaaaatacaggttcattatatgtttatccacatcccgtatcagattttcaatcagcagggcctcctgggcgttcaatattttggcggattccgtccgatccgaaataaaaaacatatgcgtactgtaactggccgccgcaaaaaacaacagcagaaccaccagattaatcagagcaatcccaaggaacacctcatatttgatactgctgaaaaattttgcgcagaacttccgtattcccttcataccttaccgccctcaaaggccgcttttttatcctacagcagccaacactgatccgtctttatctgtcccgtatgttcaaaaggtgcctctctgatcacaaatgtcagcttttgtccttcggaaaaacgaagtagttttaatactatctgattttccccttttttcagcctgctattcaccaaatcattatatggcgagtagcctttgcagtcctccattgcatagacttccttaccgtttacccacagcttgaagggtgtggtacttccgatatgaaactgtacttcctcatccgtcttcaggcacagcttctgcagcgcataaatgcagcagggacctttataaccgagcatttcatctatcctcagactgtcctcacctgcatagtacctcttcccggcgtcgaaataatcggaaaatgtgtcgctgtcaaaatcttcggatatatattcccggttaagaaaggcaaaattgttatgggcctctgccagagataaataacgaaagattttgtgttcaggaaacggaaaatacattttttgatttatgcgctcttcctcagatacctttttccagtcaaacatatcccaaaacggccccaatatgcggaatggctgtacgcctgccaggccgatgctctgaatccggcttgtttttccgtcggtgtccttcagggaagccttgatcacataatgatccgataggcagcgcactgtttcctccatgtgtaccgtataaaaatattccgttcctttttctgtcttttccgtacggcctttatccattttcaggccgtcagggagatcccatacaagcttattctcttctcctgccggaaatagaggaagctttacccgtatttccgcggttttggcagggccgatttccggcagccccacatagtccatcctaaacgaatccgcctgctcctttccgcattcctgtaaatccgtctctattccgaaattacaggttacccgggacaacttatcaatagtaagtatatcataatgcagattcacacatccggtaattatttcctctccgcagtaacccagccattttttcccaaaaatctcttctccataaataattcccagaacagcgcccagcgtggcagccgtacaatctgtatcataaccgcagttaaccgccagtgtaatggttttttcaaattcaccgtttccgtaaaggagcgcgaggacaataacgccgatgttgtaaaaagaaatggaacagtccacatctctatattctgtttccagataatccatcactttttccagctcagagcccttctcaaaggctccggaaatatctgagattacatgatatatgcggctggtctcagggatatattccatagctttttttatgagctccagcctgtcctgactcaaaaaggaaagagattccagcgccgtaagatactgctccgcataaatgctctcttccccatgatccaggcatccgtcacgataagcaagctctatccctttttccggccttcccggacagatcatggcccagatttccgcacggatagggcatcccatggaattcatgaaaaattcattcgcgaaagtgccgctgaccggaggctttattcctcttctgtaattccgcttcccgtatccgtattcgttgggattggcgggatagcatttaatgaattcttccatcaggtcatcacttgtaaaggaaagccctttttccagtaacacctggagccagacaagctgtaaatccagatcatcgtttgcaagcattttttcaggcataaaatcttccggcttcaggaaataagagcgttttttcagacattccggtatcgccccaagattccctccgatacattttccgagccatccggctctcacctttttcctgtaactatcctcgttcagcctcatccgctttctcctcccataatccatatgcatgatccgtctttatccggccagacagttcatatggagcctcacgcataaccatggtaaatttctgcccttccgaataccgtagcagctttaatacaatcctgttttctcccgcttttaaatccattttaaagacatccgtatagggagaataaccgttggaatttttctgtgtataaatcagttttccgttcagccagagcttatagggcgttgtacttccgatatggcactgaacagtttcctcccgttccgaatacatctgctgggcacagtacacacagcaacagcccccaaatccgaacatttcgtcaatacggacagtatcttcagccgcttcgtacagacgtccttttctgtataaatcaaggaagccttcccctgaaaaatcttcttcccgataaggttcgtccagatagacaaaattgttatgcgcttccgccaggttataatatctgtatatcttacgggacgggattttgaaataggcttcttccgccctgcgcttctcttcactgacttttttgaaatcatagggattaaaaaacggcccggtaattctccatacaggctttcctgccagcccgaaacaggcttcctcctgcaaacttccattcttcccatatactttgcagaaaaaaaggttggtgtcataaacgaccggagatgcttcccggtatttgataaggaaacgaagcctcctgcattctcccggtgcgatatccttcgtatctccttccggacatatttcaaaagcctctctgccggccacttccagatactgttcatctttgctgttattctttaccgcaacaagaacagtacaggaatcatgaagccctatttccggcaggccttcgtaatcaatggtaataaaagccgctttttctccggattcgaaaaagatatcatcctttttctccgggacattcctgataatacgctttttctctccgtcatacagacatcccaaactgcagatagtgtctgtcagctccgataaagtatgaaactctgttttgagattaacacaggcggtgacaatcctgtcctctatcgtttctttccattcgtccggcactgcctccgtacctttccatgctcccaggaaggcacccactgttgctgccgtgcagtccgtatcataacctccgtttatggcaagaagaactgtttcttcaaattttccttccccatacagcagcgccaggatttccaccccgaaattataaaagctgatggacgaatcattactcgcataggtatcatgaagctctgtaacgctttccttccatgtgcatccctctctgtaccatgcaagacatgtcctcacaactccggcaatccggctttcttccgggatgaaggcaagcccatattccaaaataaccgtgagctcagtaaaagaaaaggcaagacattcaattgccgccgtatactgctccgcataaatactttccgcaccgtggtcaatacacccgtccatatagctgtattccactgccttttccggataaaaaggaaacaggctggcccagatttccgcacgtatgggacagcccatggaatacatgaaaaattcattggcataggttccgctcaaaggagggttaattccccttctgtaatttctttttccatatccatattcattcggcccatatggataatgggcgataaatgcttccatgagatcatcactggttaattcccagcctttttccagaagtacgttcagccagatcaactgaacgtccagatcatcattcaccatcatttcttccggggctatctcatgcagcgactgaaaatccataatttccctgcagtcctccaacggcccgcctatgttgccggctatcattttccccagccagcagccataaaccctgtccttatatgtatcataattcatccttcttctcctctcactttttcatgtactagcccttaaccgctcccgatgccatccctttataaaactgctcctgaaaacacaaaaacaggagaatcggaaaaataatggagatgacagacaccgcaaaaatagaaccataatccgccgccccattctgcttcacaaagctgtaaattgcaatcggcagagtccttttgctttcactggaaataaacagcagcggattaaaaaaatcattccatacgggaagggtatttataataacaatagtaatcacagccggtttcagaagcggtaaaataatgcgcataaagacactgattcttccgcagccatccatgattgccgcctcttccagctcccgcggaatagatttgacataagccgaaaataccataattgttatgggcatcagacttcccgtcgataccagaatcagcgcacccagcgaattcatcagccgcagacctttaatcagctgaaacaaagggacaattcccgctgaaaaaggtatcatcaatccgctgaggaaaaaaagataaagcaccagatagatccctttggatttccttcccagagggtaggcggccagagaaccgattaatacaatcagaatcattgatgccgcaacgacgataaagctgttcttcagcatgccaaggacattaaggtttatgaatacattttcatagtttcccagataaagactgtgcggcagactgagaggctccccgatttcacttcttgttttaaagctggaaaccacagcatacagtaccgggaaaagaacaaccagggacagaagaagcatcaccgcttccagacaaaactgttttacccgtttcatcacatttccacctcctttttccgtgttgcaaccacctgcacgatagacaccacagcaatcaccagaaggaaaacaaccgaaacagccgatgcataacccatcttacgctccttaaatgccattctgtatatcaccatgcttacggtttccgtagcatcattgggagctcctgccgtaagtgtataaggcaaatcaaagagcttcagccctcccgtcagattcaggaatgtgaggattgtcacggaaggcataaggagcggaaaggttatcttccggaaaatctggaagggtctagctccgtcgatctttgccgcttcatacaggttttccggtatcgtctgcagcccgcccagataaataatggctccgtatcccagccattgccatatattaaccacacacaccatgataaacgccgcagtttcattgccgaaccagtcaatcacaaactttcccagccccgcttccctgaaaaaagtatttagtatcccgttatactgcataatatgcccgaatacaacagaaaccaccaccgtacagagcagtactggaacataaaacgccactctgagataccttttcaatatcagctttttgtccaggacaagcgccagcagcagctggaatatattgcataacaaacagtttaccactgcaaattttaacgtatttcctatccccgcttttatatatttgctggagaatattttcatataatttgtcagccccacaaaatcaaagcttttcgacattccgtcataattggtaaatgaataaagaatgctcttaataagcggataccagataacggcaaagaataaaacaaatgcgggcagaataaaaagcatatcccacaaataatcccagaccttttttttcttcataccataactcctttttttaaaaaagggagcccgcctgcggcagactccctcccatcacttaatatacaagcaacggccggataacggaatccttatcttcctgatatgcagaatccatatcactgataatctgatcaatgtcaccgcttccggaaagtatggcggtaatccccttatctacaacagtattgcaggaaccgggccagaaggaatcaaagaaggcatacaccttgtgatccttcatagcttcatataattctctggaagccgcgggcatgtcatactctatgccgtctgcgcagggaatggtttttatctgttccagcatattgctcaggacttcaggctgggcaatataattgatgaattccttacagatttcagtattctggctcgtaggactgtagcctatcgctttatcaacaaaggctaccactgctgattcgccttctttgttggggaaaggaaaataaccgatttccacattgggatccagatcctgaaatacactcaccgcatagctgctcagcaaaagcatacctgcttctccggctgccacactttgggccgcctgattcaagtccacgcccatcgttccttctgtgaaatatcctctgtcattcagctctttcattacttcaaaagcatctttatatctggagtccttaaaggttgtttccccgtcatataatttggtgccgaattcttcatcataaagtgtctggaaagacgccactaccgatgaaaaagcatgataggaggtccagttatcctttgcgcccaatgcaacaggcgtaattcctttggatttcagggtatcacatacggtcagaaaatcttcatatgtttcagggactttaagtccgttgtcttcaaataccttcttgttgtaaaataccccttctcccgaacaatccagaggataggcgtacagggtaccttcataggtcatattctgcttaaaggaaggattgagatctcctacccacgcgcttccctcatccaggcttccccaataaccgttctgggccattttgaaaacggaactaccgaaatacatgaataaatcgggtgcttcatctgacatgattcttgaaagaagtactgtttcatagtctcctgcgggaacctccagttcaacggtcactcccggatggctttcctgaaaaccggctaccgcctgcttcagcggctcggtataagcgctttcccaatacatcagcttcagctttgcattttcttcagatgccgtgttttccccctcgtttgctgtgctttctttctgcatttcctgtgttgtctccgtaacagcagatgactggctgtccccatttccgcttccgcaagcggttaaggtgaataccaatgctgtactcaacaacatactcatgattcttttcatacttttccctccatttgtatattgcatatgcttttttcttgtttcaatatgattttatgtaatttttatatgtttttctatttcacttttttaagatagtatatgcatttttaagatcttttatgggatatgggaagagattgtgtaccaaatgaacatttcagagaagaagatgggatgcatataggaatagttgtgtctaaatacagttattttaattattggctattaactgatggaatcctgtcggaatttgcttgtctgtcttaattctgtattttgcatagtgaatgatgctatttttgtatcctttttgttgcctgcagtctttataccttttgttgttaataagtctctgttggaatatttaggacttgcggtgaagggaatataaaggatggagggattggtgaacggtgagcagaatattttgacaatttgggatttgacgtgaagcaggttgagacttttctttatgactatcgtatgattacgaatagttgaaatactcagtaagtgtagtacatattaatagttgatttagtcattttcatacgtgaggatgtgtatgtgaagaacatcgacatgccggtaaaaaaagtgtaaaaacgtttctggttatctaggaatgcccagatggaaatagaaccgctttgtattataatgtgaatgtagggcttaatagagttaaatgcttattgattatttgcataatcaattaatatatgaatattagataagcttttgtaataagtgatggataaacacatttataataaaaaattatttttgtagaatcaaagaaatattcaaaatatcttatattactattaaacaagagggaaaacaaggaacagttgtcttgattgaatttcaaaatatcttatattactattaaacgcttaagcctggtgtcgggtgtggagctggtggcatttcaaaatatcttatattactattaaacttataaaaccgatcctggatgcctgcgcagccttatttcaaaatatcttatattactattaaactcggatccccgttttgttttcacatattccacttcatttcaaaatatcttatattactattaaactcttttccggtttccaccggaatagtaactgtattatttcaaaatatcttatattactattaaactatacccagataagaaaaagatgctggcatctcagctatttcaaaatatcttatattactattaaacaacgaatacggaagcgctgtccctcatccggtcctgatttcaaaatatcttatattactattaaacgggaacatcccagcagctccgtagcctcattggtgcatttcaaaatatcttatattactattaaacctatcatgttctaatggggcagtcgatcgaagaagatttcaaaatatcttatattactattaaacttctttcggatttttgtagcggtaagggaatagaatttcaaaatatcttatattactattaaactacccaaaggaaaccttaacttcttgtccaatctccaatttcaaaatatcttatattactattaaacaggtagaaaaaacagaaggaccttccagagtggaacatttcaaaatatcttatattactattaaactgccagagctttcagtgctttttccacatcctccttcatttcaaaatatcttatattactattaaacgggaatgtaggagctcatggcaaattgtatcataaccatttcaaaatatcttatattactattaaacgcagaatgggggacagacaataataccacctatacatttcaaaatatcttatattactattaaacccggaatacaaagtccgtacgcattaagtccttccaatttcaaaatatcttatattactattaaaccgtatatgggttgctttcaaacaccaatatggcatatttcaaaatatcttatattactattaaactatgcgtgtgcagcagcgcacagatgggagaaggatttcaaaatatcttatattactattaaacccaccaagttcaccagcaatggaattatagtcatatttcaaaatatcttatattactattaaactaaatttttagcatcgattgaggacaagaagaaaacatttcaaaatatcttatattactattaaacaatataaccctacagggattggaaggataaataaatttcaaaatatcttatattactattaaacatgccggagaggtaaataaggataatgcaaaagaatttcaaaatatcttatattactattaaacttttcacgatcccaacatataaatgattcatcattatttcaaaatatcttatattactattaaacttggttctggcggaacaaatatttctctattatcatttcaaaatatcttatattactattaaacggaaactgtccagcggtgcatccggttccccacacccatttcaaaatatcttatattactattaaaccgtctaaagacccataattacatttttcacattcatttcaaaatatcttatattactattaaacgacacgttgggagaggattgcgcctatgaggtggatttcaaaatatcttatattactattaaacattatcatgtgtcgataaagcattttgcttttcaaatttcaaaatatcttatattactattaaacatataggagaaacatacactataaggtcaatagacgaatttcaaaatatcttatattactattaaactccgtgtacactccgctaccggttaccagtcgcgatttcaaaatatcttatattactattaaacaacctatgagttcgtaaaatataatcccacaattatttcaaaatatcttatattactattaaacaacgccggtagcttctggttacactgccaaagttggatttcaaaatatcttatattactattaaacgttccatggcggctacgccagaaacgcccgtcttatttcaaaatatcttatattactattaaacatgaatatcattgctgccattatgaaattggatgcaaatttcaaaatatcttatattactattaaacccggccccgcgaactgatcgagttcctcaaaccataatttcaaaatatcttatattactattaaacatcgctgctgtaaggccctgcttatacatattgtatttcaaaatatcttatattactattaaacgtttgggccatgcgaatgcgtggcccttttcttaatttcaaaatatcttatattactattaaacatacatacctggcaatatttgaagggagataagaaatttcaaaatatcttatattactattaaactcttttatattcgcactgctccataaaagaaacaccatttcaaaatatcttatattactattaaacttcctgggggtatttatttgcagagagatatatcctgatttcaaaatatcttatattactattaaacgaatacctgtatattatcccgatatatctcagtaatatttcaaaatatcttatattactattaaacttaaaaatggtgagctgattaaggccttcctgccgaaatttcaaaatatcttatattactattaaacagcgtagcaacggcggagcagatggcagcatatcatttcaaaatatcttatattactattaaaccggagaaaacacaatattttgaatccagcgattatgatttcaaaatatcttatattactattaaacaaaatggatcggagaacgggagatccagaaaatatcatttcaaaatatcttatattactattaaacaatatgacctgaccatacgtcagattgaaaatgtatatttcaaaatatcttatattactattaaacccggtatatagacaattgcgtttgccttgttaaaatttcaaaatatcttatattactattaaactaagagaaaattctttgagccaataattatcatcatttcaaaatatcttatattactattaaaccagtttcaaaagcatcattatcggaatcgacattaatttcaaaatatcttatattactattaaacgcgacactgtttccgtaccgtctacaccattaccatttcaaaatatcttatattactattaaacatgtaacaccatttatcacattggagccagtaaaaatttcaaaatatcttatattactattaaacagattatgcggaaggtaaacaggggacagtagttcatttcaaaatatcttatattactattaaactgtatgctgtttgccagatggctgctaaactcaatctatttcaaaatatcttatattactattaaacgactatttcggtgccggcggaaggaagtacttcaagatttcaaaatatcttatattactattaaactaacagtggacttaaaaattgtcttttatgtgctatttcaaaatatcttatattactattaaacccattctcccgggcaattactgtctgcaaattcggatttcaaaatatcttatattactattaaaccaatagagtttgagcgctgcgataagccagataagatttcaaaatatcttatattactattaaacttagtaaagagggctttacgctataactatattatatttcaaaatatcttatattactattaaacttatgtattttataaagcaaaatccagatctattatttcaaaatatcttatattactattaaacgcgtccgtccagtattgccctgaccatatccccgtatttcaaaatatcttatattactattaaacataaatccggcacccactcaccaaacaagtcagccatatttcaaaatatcttatattactattaaaccacgggtaggagaggttccggacatcaagatagcatttcaaaatatcttatattactattaaaccaggagatatccgatagaattgagcgtatggaagaatttcaaaatatcttatattactattaaacgagttattcccctctttatttatgcccttaaaagcatttcaaaatatcttatattactattaaacaacatactgtatcgttggcgggagaagtagcaaaatttcaaaatatcttatattactattaaactaccccgattcttgttgcgcagagcgagcgattaatatttcaaaatatcttatattactattaaacgccgaaggccatcatcccctatatctaatagtgggaatttcaaaatatcttatattactattaaaccaacgcaaatccccccttctcctatttactatactaaataaatccccataatacaaccaattccagcttttttaccaagtccgcccccacccagacatcaacatatcaaaaacacctacaatgccagtaaaatcaaccatctcacatacaaactcctattttgcgcctggtaaatttcatataccatttttcaaataatcaaatcttctcctgttacctcatcccttttccctaatatctcttcaccaaaaacattattattcattagttttattatacatataaaatcttcatttttatttattattttattcagctctgtttttagttcaataagcttggaaggcgttatttctcctctgaaaacagaaaattgaaaatgagacaagtatttcttacaaatcttaaaaaccttctgaaccctcttttcatttacatcataaaagacaaacgcataattatatgtaagctgttttttcattaaatattctccttcaatgaaaatggaacaaatttctcatcttctaaaataaattttatcaatttatagcaatccaattttatggcagtacgataactgacttttctctttagcctggaatgcataaacactgtttccatacgctgttcaaaggcctcaacaaatatttttctgccttcttcattcagcaaacaataatttacctttttatcaaaatgtttatctacctgcaatcgccggttattgactaattcaaaaatagttctgtatacaatgacaggtttaaacacctcactaatatccagacttaaggaaaatctggcctcagcgggttcatgcagaaagctgatacgttgatccaaatgcgttctgtatatcgcagaaattgttttcgtatataacaaagtattaccaaaagaaatcatcgcattaatgggattatccggaggacgctttacgcgcttattcattataaaatcttccggtaagaagtacttgaatgtaccataaaatttactccatgcttccccttcatatgccattaattccgccggttttactgctgtatcaaccctggaaggaaactccttttttaaccagtcaattgtatcctttacttcttttttgtcatgtttataatagtggtaaagaatttcggacatatttatcccgataccattaacaatcgcttttgcaatatccattctggaattttcaaatgtattaacctgcctgataagaagctttccgctattataataatccctgggataaaaggtaccgctgtatccttcataatcaatgtaccatttactctcatattctctccttagtcaacaaacaatgctcctctgctttccagggctttcctgtccagctttccgtttatgaaatactgttctccgtcccggatacagtatagttctccgcagacaccatcataatttaagtcctgattccatttaacctggtaaataaacatattcaatttacttctcacttctgataattccacctgcttccttgcaaaagagattgtctgattatggagcaattccaaatattgattccatacctcccacccatccattattatgccgttttccataaccagccttctgcataataccaggctcattctcctgttatccggttcaattaatttcattctatccgctaccatggcaaaattcagattttttacagtctcaccgaaaaagcgttccagaccatcggatgatgtactctcatttcgctgcatgcgcaatacttccaacacttcttgataataatctccgaattccttttgtctgagtatttcccgcatccggggttgccgaagagtaaatttctcatctgtccgataatcatcccgataaattctttccgttttatccatatcaaagaagtaaaccatcccgtcgtttttgtatgatctatttatccgccctaaaaactgttcttcactgtctaattttgaaatatccttaaaccctaaatccatgtcgatatcaatacctgcttcaattacctgtgttgatacaaggataaggccccttgcctttttttcccgaataggtctgagaatcatttccctctcatactccgaatcgtctcctgtaattaaatttacaggaatattaatatcttcatctgccagaagccgattataaaattcatatgcagaatctttcctgataaatgtcacaagaatctttttatttggcgtacagtgcctttttacctgatcaagcaaggtatccattgtcattttctgatccagtagttcataggaaatcttgacacgttcaagaaataacggattcttataatatttatttctgtcctcaatcaaacgtgtaaccgtatactccttacctcccagtacctccagtcccggcagcgttgctgacatgataataatcttcattcccatcaagtaagcgcattctcttaaaaagataatgatttccgcccaaattgaattacgataactctgaatttcatccagtatcacaacactgccggataattggacaaaactaaataagttttctctgccgtttccgaataaagtttcaaaaaaactgacatgggtagatagtataaagggataatttaaaaactgcctatccagaagcgctttctgataatactcctcggtattatcttccttagcatgaatcccttttattggtgtcagagaatttacagtgactatttgttctttcacttccgaatgcttaaaaatatcctgcaatattattttattttgatccaccaatgtattgaatggataaatataaaagatctttttacctgttccaagtaactgcaggctcagattcaaggcagtattgcttttaccgcttccggtaggggcttccagaaaataaatcaattcattcggatatctttgcagcattttctctgcatccaaatacatttcgctgcgcatgacattaatatctttacaattcttcagattctcagcattcctgccatatgattcccgctcgtattcttttatttcttttacaagcttcgaatccgcatatggtttagaaaaatcctctccgttacaaatacttccaaaggactctatttccacatcctccatatattccgttgttgcataataatcacaggaaaccaatacagaataagcaaaacggacatagaaatatcctgctatatcctgctgccttgtgaatttctttttaattcgtcttaaccgttttgctttttttatcagattctctttcgaaaatgactgtaattctttcaggccgggaattgcattcctgcccaatgcttcagtcagttcgcccaaaacatcatctgcatcaaatttctcaatgaaactgcttaaactgtccatattactatggtgtcttgatatcacatatgcattttcccataacaaaacgaaaagaatatcctgtatgtaatcttcaaaatcagaatgttctattcttgtaagataataatcaagatacaggaatgctgaaaacaaagaatgctctcttcctgataagccttctaacctagtgacaggcatccgcttattgcccatttttaaaatttggaactgtggatttactttcccaaaatcatggaatggaatcatctggcgaaacatatcatatacgaagtcttcaagttttttttcaattgctgttccctcaggcaaatgcctcattaaaaatctatgaatgatttccggcagttctttttctttctcgatcctgcagaaatatttttcgcataacagaatatgctcctgtatattttcattttcctttttaccgttttccatccgatgcgcaaagatcggatattctccattaaaaatatcgttccatgacacaaaatcagccatttcttttctcctaaaatcaatgatatcgtaatgtaattatcatgtgtttcatgtgcaaacgccgcacaataggtaataaatcttcctattctgcggcgcttacaccctccattcggcatgttaaaaaaataaaagatttcttccttcaaccttataaaccggctgcatacactgatccatttcagcgtccgtaaaaataaaacgatgggttctgtatagattcgtactctctttcagcccgacaggaagatattcttcgtatcgataggtcatatcatcccaatcaaattgtacggctccttcggggaccaaactgtcagcagtttcattctttgggaagcgctcctccccggatacgatacacattccgctgatatccgccatatggtcatttttccccagatatggcatataagtacattttctcgccataatgcgctctgcaagttcccggctttcctcatcctttatctgaatatagatagtccattcgggattttccagccactgttcctttacaatcagatttccccctgcttccttggaggcataacctacggaattattgaaaacctggatttttttctggaaatatccctgtttctgttccggtacaattgaaacattcagatactgcagtttttcataaaattccggatagtctttatcttccatttggtagcctttatagcccatgatagctccgagcatccccaaaagcgctactttatggatatttccataggtgaaatagtaatacgtattcacctccggaactttaaaaaaagcgtgtgatcctttcagattaaattttaatatttccatatacattctcctgtaatgtcctatagagcgtcctgtcctatttctttccgggtgataatattatagaaattcgcatcttttatatcagtatccattacagttgtataagaattaaagtaaatttccacagatttaatccggtctctcacttcattcaataactcatcacagagcagatgaattatatttttattttcccctttttcaaaagatacatattccgacaggttaggaagatataagtcctcttctgtttccacaaataaggcaaactcattttcacagcctacttttgcattcgtagcaaatgcagtaacggcaactaaagaggtatccttaaagttctgataatcttcttccgtatatccttccgtcactccaagctccacaaattctttatatgccaggggattaataacaaagggataaaaatagtgagcttcattacttacaatttttgttcccaaagtactgttcttcgcttcacctttcttctctgttgtctttgtggcatctctgaatggagaaagtatgggttgttcctgacgctccgtaccttcatatttattaaatccctgcccgatttgtaccgcaccggttattgaaatgttactgcctgattcagcaaaggttgcaccgaaatttttaacatcaacggcctgaaacaggtttttaagtatctctttattatctttgctttcttctttgataccaaaaacgtactcataacgttccttcaggcttctgggtataagtaccgcctctccttttttgtctgctttcaggcataaggatttaatataaattacaggtttcccctgattttcccacatctttttcataggatattttaatgctttatcacttccaaatgtagttccatctgaagttgttttagggtatcctgaaaaatccgcattccagtttgccatgatagaagatattccaagaattccgtatactctcttattcattgcttgtcctcctgtgcatctgcattaatctcttgttctgtattctttttttcataaagtaaagatggggatgcataacctgctcctatccatttacaattaagtttggctcctttttccggtacataagccatgatctgtccgaataacctctctgcacgacccagacttttatgtgatatatcataattgtacttcttatataactgcaaaagtctttcctgggcaatatcgtggtttttagcattcaagaaaggatttacccatgaagaaggaattttattggctttgctcctggaaatcaggaacgaaactacctgccccaaagcataactaaattcttcctctgagctgaatgtccattcctcttttgatgccatatgctctctcagctgacttcttacatccataaccatattttccctccttttacttccttccagataatccaataaagcccatcttaaattaaactgtctctgtgcacgcaatattcgatttgaagatatcgtattaaaaatcaattctatggatactttatcaataacagaacttatttgttccatttttcctgtataaaaccaggaaataagccggttccttgtttccaggatacatcttttcaatacattatctgtaattgcaatatcctttgcatctgtatagaaattagaagataatttattttcaaagaattccctgtcaataatatttttcagttcccatagctgtctgcaagcaatattgtattccagtttgaatttttctaatgtctcatcctggatctcaataatatttctaagccagaaaactttatccagttttttcctataattagtcaccgtatctgcccaatgaatttccagttcctttcctttacgcagccggtaataatagccgctttccaaatcttccggttcttctgtattgctgtaacctcttatagtctgtgccgtataatcgatatacacattgactaatccttttgatgcgaagccgcctaaataatcgaacatttctgccagaagacaggccttctctttatccaccagattagggacactcacttttctccccagattaggcagatatggcttcttggcattcatgcccatattattattaggaagccccagaataacgccattttcttccacattgtaatcattgctgttatagatgttgggaagcaggtaacgtctgccttctttataataaactgactttgttttctctctgtcaggatatacaaagaaaagctttatgtactcctttttctcaaaatcaatatcttcccaaaccttttcttcttttacatattcagcgattctctccagcaattcctcatcaatcccgcctgtttcctgtacagtggattgatataatgcctttgcctgtggctttttatatttttccatcggattctttaacacagcataatagccttccagaatttttccggtgagcttatgttccttaatagtttccttcttaacaaaaagtgacagataattattggaatggataagctttgatgaatccatcggcttattcatatcaatcagtttactataataatccagataacagaaaaacggataatcggaatcagccttccctataatctcgccggtctttttatcataacggatataaagtgtttttcctgtctgatatccgtcgtccgtcagttctatcaatcgataggtaccgtctttcggaacatattcatccagtatcagcctgtcattcttttcccgcattcgctgaaaaacagctagtccttcctgcagcacattttcacctcctatcagatgtattgataattcatgaatcccgaagctctggcattgttctctcccagccctgtccctagtgaaaaatataaaagctcctgggccataggatcattcgatgcaatgaggtttatcttatctcctaaaagtgttatatttttataggggacttttaccggaactttgtttttaaattcaattagattataaagctgaaaattttcttcgattttcgtatgattaaattgattgtatttttttatcaaatttatcttaatacgatcttcgaattcagggacactcatatgctcacgccaatatcctttttccgttttaattattacaggcgtaagcgagtatactctttccagctgctttttaggaataatccgcagttcacctgttaatccttccatttcccctgaagtatgatgaatcagcatccttgaaaaatattccgctaattcctgtttgaccgtccggattcttattgcatagattttaccctgtttataaatgccgtctttctcacatggataaaatgaatccatcgtataatatttgtattctcttctttcatgcagtttcagaaaatcctcctcttttcctaatgcgctgtcaagaaaataagaaacagcttcggatgctttcacgtattcgaatgatttcagaagacggacacgcagcttgtactcaaataccagcaattttaactacctcctttcttttgtttgaaataatgttataaaataaattgtgatttaataattgtattatatatccaatttatttacttttcaatgttaattttataaatacattaatcatttatattagacaacaaaagtgttgacaataccaacattataatttaatctgagtatatatcagtaacacgatgtgttttgaaatatgtttattttttaaattactcttttaatactaacataatgatgtatatacaatttctaatctctttgaatcagttctattctatataaggaaatagcgcagtgctaataatcccatatctttaaccgttttgattcagaaagtttaatccctctattttatttgaaagtataatgacagacatatttatatttgataaactagattcgtccagttacttatgatctggagaaaagaaggtgataaattgtttacatgtggtgataaaataggaatagtcgcttgttcaaatggtctgctgaaatcagataaaaatcacgttacagaattaatgaaaacattgacggatttaaaacttgttccagcattaagtccatatatctttgaagtgaattctgtgttcagcggaactgtaagggaacgtgctaatgctcttttaagcttctattccgacaaaagcataaaagctatttttgatatttcaggaggtgacatagcaaatgaactccttgattttcttgattacgatttaattaaaaataatccaaaaccattttggggatatagtgatttaaccaccattttaaatgctatttacagaaaaactggtgtgccatcctacttgtatcaaattaaaaatttaatttgggagaataaacgaaatcaaattagagattttaaaaatacagtttttaataatcaaaacagtttatatgatattcaatggaagtttgttcagggatcagagatgaaaggcatcgtaataggagggaatatccgttgttttttaaagcttgccggaacaccttatatgcctgatttcaaaaataaaattttgtttttagaaagttatggtggtaatgccgccctaatgacaacgtatctttgtcagcttaaacagcttggtgcatataaaaatattgcaggattacttttggggacctttacaaagatggaagaaatgaatgaatctcccggaataattgatcttgtttctcgtattattgacaatcccagatttcctatcgccaaaacagatgaagtcggtcacaataatacctccaagtgcttgataataggaaaagaatatgcggtaaatgatacgcagcatacaaaataacggaattagctatttatgtttagtaactgacagaagagcaaaagcaacgagtgtttttgctctcctgtataaggaaagattcccaaagcaggaagatacattcctttattatatatcatgttccgaaaaccgaattaggagtctaatagtttagattctctaatctcctaaaacatatcatgactgctatcacctaaccaccacaaaataatccccataccgcgtaccatcatgcccaatcactttttcctccgctgccgcaaaccccagcctcttcaggccctttatccgctccgctgcccccggtaccgccttcgttgcaattttaccacaccgaaacagctcaaaagccggttccaatatcaacgatactattcttactatctcctcttcccgctcatagtcacttctgatatccagccgcagcagaccgcagtccgtaaaataatcggccgcatccctgtgaaacaactctatagttccgataacgcatccgctctgcttatccactatagaccatcgaacaaaccctctttcttcataggaaagccgccacatacggattatttccttcatacgctcttccgtagtcagataaaagtcctccccattgcagttatcactattgaaaaaaggcaccgcatccttatccgaatacactttcagcaaatcctgccagtcgctctctgaagtaagcttcatcagatacttatcatcttccagctgcggacagtccgcatatacatccatattccaaaatacattttcccttttcacgctgtttttatttcccatttttttacctcatacattctcacatataatctggttttctgttaacagcatcattataaacaccctactatgacacctatatgtcatagttctccaaaattcctgaaacttttcaccagttcaggcttatcataattcttacaagctttccgccccatccgcataccactgtttctgcagcgaatacatcctccggaattccccatctctgtccatcagttcccggaaggttccctgctccgcaatacgtccctttttcagcaccacaattctgtccgcaatcttcaccgagcccagccggtgcgtcacaatcacagccgtctttcctctggatatatccgcaaatttccggaacatcatagtttcctcgtaaggatcgatagccgaagtcggttcatccagtatgataagctcatgctccctgtagtatcctctggcgatggcaaccctctgccactggccgcctgaaaggtccgttcccccgaattcctttcccaaaagtgtctcatacccgtccctcagtccccatgcagtcagctcgacactgcttttttcacacacctcatccagcagcgaagccgtggggtctttttcactgcggcttatgacaatattatccttaagagaaaggctgtacttctggaatttctgaaataccaccgcggttttctcatagatattccgtcttttaagctttgccaaatcctgtccgtcaacctccacacagcccttatcaggcatatataaaccagtgagcagcctgaccagcgttgttttcccggagccattttctcctacaacggcaagtgtttcccctttctttatttccagtgaaatatccgaaagcgcttccgtccgggcctccgggtaggaaaagctcaccttactaagcctgatattatgaaaggcaagctgggcttcctgtgttccatcttggctttccatttccagaaagtccataaaattattcacttttcccatcccctgtgccatatgccccacatggtagcaaatcaattcttccatgaaatcataaagtgtactcaaagagttaaatacggcgataaaggctcccaccgggatttctcccctcatcacggcctttacaagcatcaccagaatcagaaggtagctggccagcgtgatcagcttcattaccagttcgagcccgttggaatttaaggtcgccttatatttcagactcagcagttccttcttcgtctgcgcgtatttcccgcggaagtaatggaaggctcccagcattctggtttccttaaaatactctctgctgaccatacagttctcataataggtattctcccgcctgagagacgccgattcctcctccagctttccgaaggctcttgtccgtacgatctgtgtcagtgcggtgggaatgaaaaccagcacgacagcgacggcaagcaccggctttaaatgaaagagataccatgccataaaaagaaaataaggcaggtaaaaggtaaaaaccccctgcaaagcggaaaccagttccactgcattattttttccttcctctgctttattgaagatatccagtttatcgggctcctcaaaatagatcggcttcatcgccgccatcttttcatggataaaaaaggacagccggccttccgcttttttctccatcatttcgttgagataatttccggcgccgttaaatatgtggcagagcacataagcgattcccagcaggaaaaaggcggccagcactctttttaaagaagcttttcctgttgcaaactctgttactccatcaaaaaaaatctgctgtcccgcagtaacggctccccaggaaacaccatgaaacaccgccataaccgttgtcagaaggaatgcgcccggagccgcttttatgaccaggggcgtcagtttccataataattttacagggcctctttttttcttattcattgataccagctcctctgtgcttcaaacatttccgcataaattccctgctttgccatcagttgttcatggcttccggtttccgccgcatttccgccgtccagaacgacaatggtatccgccagtctggcagcccccagtctgtgggtaataaatatggtggtcacatcccggctggcttccccgaaaatccggtacacattgctttccgatacgggatccagcgctgcggtgggttcatccatgatgcgtatggaggcccgctgatacagcgctctgcctatggctattttctgccattgaccgccggaaagatccactccgttcttttttatcttccccaggcaggtatctgtcccattcggcagtgcctgggcaatttccccgatttcattaaatgaaagaacctgggaaaatctggcttcatcgttttccgtccggttccccaaacgtatgttatcagcaaatgaaatctggtatctggcgaaatcctggtagaccacggaaaacatatccatcagctggcggctgtcatattctctgctgtttctgccgttaataaaaatgtctccttcatactcccggtacaggccggtcagaagcttgacaatcgtggtctttccagcaccgttgattccaacaaacgcataatgccttcctttttctatccggagggaaaaatgcttcagtatgtagctgtcggttccgggatagcggaaagaaacatcccggaactccacctcttccaccacatccgggctggcgttcttttccttcagtgcaccgtcatcctccgacaaacccacgaattccgtcaaatcatccatgtacgccttgtttttcgccatctgctcggtaagcctggcaagctgccaggacatcagctggatcagttcaagcgcagcagaaaccagagctatgaacatccccgccgtgagctttccctgagaaaggggataaagcagaacaaggatgattatcagggatatcgccacggtaatcaggctggagcctttcattttaatataattccggagcattacgctcattgtaatttttcttgccgtttcatacttttccagccattttttattcagccagtccgagtaaccgaagagtgtccgttcttccgcactctccctttccgtcaggaccttatgcaggtactcagcctctcttgtctttttttccgcattccggtatgcctcataattttcttttcccgccttcagggaaacccggaacagcggtatggagacagccagtatggccagccctatccaccatacctgcagcgtaaggataataagcaaagataaaacccggatgagcagctctcccatatccagcaggctgtcaaaacctctcagaagcttttccgtcgcctctttgcaggtgcggtcaaccacattccaggaatcgtcattttcaatatgccagtattccagcttccctcttttgtcaaggagtgcggtttcataggttccggcaagccgtaattccgttttcaggttcaggaatgcgatcaattggccgttcagataggtaaatgccagaatacaggcaagcagaagaagcgggacataaacctcgttcccgcctgcctttccctgtaccaccagagtcacacgatcaataaaggctgccattgtcagaacctgcaaagccggaagcagcgcggacaccagctttgtaagcaacttcagcaggcagccaaaaggataaacagaaaagggaatatacagataatcccttaatccgtattttttatccgtcaatattttttctttcatatctgtttccctcataagtcatttctcagcaaataagagctgctatgtttatccggttttattttatcatatatccgggtttctttcttcctcaaacttaattatgcagaaatatgcggcaggtcaggccgatctgcgcatttattgtatcggctgtatcaattaaaatgtaagtcctgcaaacaacagcttgtatgttttcacagcccgaaatataataggcatattaaccggcacatccgcaccaacagacggaggatctgaagatgattgatatttattacgtggaagatgatgaaaatatagcgcgcatcgtgaaagaatacctggaacagcgcagctgcagggtcagcgtttttcataccattgcagctgcccaaaaggctttcgaaggccatgtgcctgccgccgcgcttgtggactggaatatgccggacggacggggtgactcgctgtgcaggtggatccgttcccgctggaaggagctgccgcttatcttcctgactgtccggggagattcccgcgatatcgtatccggttttgaaaacggcgcggatgattatgtggtgaagccgtttgaactggaggttttatattcccgcatccgcgcattgctccgcagggcggggaatgtgcccgagcagtacctttcctgtgattccgtcaggctggatcagaaccgcatgatggttttctgcggggaagaggaaatcacgttaagccagtcggaatatcagcttttgctgcttttaatccggaataaagggaaaactgttacaagggaaaggatattgcagcagctgtgggacagcaacggcagctatgtgaatgacaatacgcttaccgttaccatgaagcgtctgcgggaaaagctgcataatccatcctgtattaaaacaatcagaagctttggctaccgtatggaggacaccttatgagcggtcataaaaataccggaattcttatatcattcgtattagccgtcggtctgctttccgcctccttcacagccgtatttatggcgagccattataaccgtgcgcagtttcagctgctgaacggcatctgccggagtattatcgaagagctgccggaagcggaaacagtaatccctgccatcctgaaggaatataagaacaaaaccgcggtgcctgaagaaaaaagcatactggccgcctacgggtaccggcagtccgacttttcaaaaggcgcccccaactatggaatattctttgccgctgccggattttttttcggcggagggctgtttctggccgccttccggcatatgcgtcgaaaagaaatgctgcggattaagtctctgacggattatctggaaagtgtgaataccgggggaaacggccttcatttacgggaagaggaggacgaattctccaagctgcaggatgaaatctataaaacggtaaccttcgcttaccagacaagggatgccgccctcacagccaggcagaattttgccgaaaatctcgccaacatcgcccatcagctcaaaacccccattacggctatccacctgtccctgcagatgatggactgtccttcggaaaaggaaaatgtcaggcagatacgcaggcagctggagcgcctgacacacctggaggaagccctgctgcttttatcccgtctggatgccgggacactgcccttcgaaaaaaaggaagcggatgtgtttaccgtcctgacgcttgcggccgacaacctgcaggaggttttttcccatgcgggggtctcagtggatatcccggaaggaaaacccgcccggataaccgccgatatggactggacgatggaagcgatcatgaatctgctgaaaaactgcacggagcatacgcctgcgggaggagttatccactgttcgtatgaacaaaatcctctttatacacaaataatcatccgggacgagggagaaggcttggcaaaagaagatctgccccaccttttcgaacgttttttccgcgggcaaaatgccaaaggcggcggtatcggaatcggcctttccctggcaaaggaaattatagaaagccagaatgggactattcatgcaaagaataatccggactccggagcctgttttgaaatccgtttttacagtcactgagatgtcactttcctttgttataataaatcatagcttctctccggtctgccggcacaggaaggagtcaaaaacataacagaaaggaaataagcagatggaaatattaaaatgcgatggagtcaggaaggtatatggatccggcaataaccaggttgttgccctggacaggattgacctgactgtaaataaaggcgaatttgttgcgatcataggggcatccggatcggggaagtccacgcttctgcatattctgggcagcgtggatcagcccacggaaggaaaggttatcgtggagggaacggatatttccacgatgaaccgcacacaggcggctattttccggcgcaggaaggtggggcttgtctatcagttttataatctgattcccaccttgaccgtccgcaagaatatcctgatgccgctcttactcgacaaacgcaagcccaatcaggaatattttcagcaggtgatacagtcccttggcatcaccgacaagctggaagctcttccgaaccagttatccgggggccagcagcagcgcgcggccattgccagatctttgatttaccgccctgccctactgctggcggacgagcccaccggcaacctggatcagaagaattccagggaaatcattgatttgctcaaattatccaaccgtaatctgaaacagaccattttgctgattacccatgatgaaaaaatcgctttggaagcggaccgcattgtgaccatagaggatggccgcattatcagcgatgagaaacgggggtgaggcagatgtggaaggattattccaggagctttatcaaaaacagccgcgcttccagtgtatcgattatggtggcagccttcattgccagcctgttcctgtcctttttatgctgtatgttttataatttctgggtatatgaggttgagaagataatcattgaggaaggcggctggcagggccgcatcacaggtctcgcccatgaagaggatatcctcacaatacagaattttgccaacgtggaaaaagccatagttaatgaagaattatccacggatcaggaaactgtggctgatgtttatttccggaatgccaggacaatttttcaggatatgcctttgattgtcaggcagcttggactggaggatgacgcggcatcctatcatctgctgcttttgtcccggtatctgatccacgatccccaggatgaaacgcctcctcttttaatgactttttatctggtggtgctgttgctgctttccctgtctctgattctggtcatccataattcatttgcggtatccatgaacgccagggttcatcagttcggcattttttccagcatcggagccacgccggggcaaatccgtacctgcctgatgcaggaggctgccgttctttgcgcagcgccggttatggttggcattttactgggaattgccctcagctatgtaacaaagcaggggatcgagatcatcggagcggacatgccgggacgatataacatcaatttcagttatcatccagccatttttgcggttaccctccttgtctccttcctgaccgtcctgttttccgcatggatcccggcacggaagctgagccggatgacacctctggatgccatccggggaaccggcggactgcagctgaaaaagaaaaaacattcccctgtcctttccctgttattcggaacggaaggcgaactggcgggaaatgccctgaaggcacaaaaaaagacactgcgtacttctacgctgtccctcaccctctctttccttggtttcaccatgatgctgtgcttttttgccctgaccgatctcagtactaaatatacgtattttcaaaaataccaggatgtgtgggatatcatggcgacggtcaagaacacaaaaatagaagatttcgggctgacacaggcactgtcggaaacggaaggggttaacgatctcgtcatataccagaaggcggaggcccttatacctgttcctgaggaagcgataagcccggaactggcttctctgggcggtcctcaggcagttgccggttcttccatttcctcggcagaaggttcctggctggtgaaagcgcccattatcataatgaatgatgatgcatttatgagatactgcgaacagctcggaataactccccgcctggacggaacgataatgctgaaccagttctgggacagcttaaacagtaatttccgtcacaggaaaatgatcccctttattaaggaaaacctggatacagcagtcctgcggaataaggacggcagctctgaaacggcggacattcccatactcggatataccggggaagcgcctggattgagagaagaatatgatgattataccctggtacagtttatcccgctgtcattatggaaaaaaataaaggaacagacaggggagccgcagaaggatacctatatccggatactggcagagaaaggagctgctcttgacgaactgaatgcgctggaggatcgtattttgcagctggtcagcgcctcctatgaagcggaaagtgagaaccgagtggaagaaaagattaccaatgacagaatcctcagcagttacaagctgattattggctctttctgtaccttactggccgtcattggaattgccaatgtgttttcgtatacgcttggtttccttcgccagaggaaacgggaactggctcaatatatgtctgtgggacttacgcctgcaggcatacggaaattattttgcatcgaagcgctggttatcgccgggcggccggttcttatcacgcttcctctgactgtgttctttatcatatttaccacgaaggccagctttctggagccgatggaggttctgccggaaattccggtaccgataattgccgcattcagtctggctatctttgcctttgtcggcctggcatattatattggcgggaaaaaagtgcttggatgcagtctggctgattctctgcgggatgacagtatggcgtagctatggctgctatgggaaaaaaatatttatatattacggttaaacctacgggagcccggagtcaagcaggcaagagaaccttcggttctctgctggcgtgcccgtttggctcgttgtccgcggaagaaatctccgggctcccgactcttttatcttttatatctctccacttttttcatcaatgcccttccctcttcttccgtccgagcatttatcgtatacatcacgccctccggcttcagattctcaagcatgatatccagttcctccggaaccacatctatctgaatcattttacctgcatcctggatttttttaagtacaggaatccaatgagaggctgtgggctgtccggctccataaacccattggatccccttaagcttatcgatcgcaagcagccgatccagatgcttcagggcatccggcccgtccagatggtagatgctggcatccagaaaatcaagctcttcaagaagctctcccaccacaagctcttcatacatctgtgtggatatcatacatgaaaaatcgcagcaggtaggataccatctgcccgggtgccaaatacccatccagcaggtgcttccttcctggtatttggtcgtcatagtatacagctcttcataaatctcccgaaaaccgggaaggagatccatggctcccttctgaataaattccggctgatccagagtgtccatgcacagctcctgaggccctctcatggacaccagtccatccagaccaggatggatatcggtaacccccacaagatattttccttttccatcctccactgctgcctgggtaatttcgagcatttttttataatattcattttgtctgcagagcttaaagccctgatattcttccacatcctcatccgtcaggaaagggacggaccagcttgtatcctctccgaattccagcttcgttccgaaacaggctgcgaaatagtccggcccaagattaggattaagcgagggaaaagcttctcctccataatatgtattacgcatctcccaattgctgcttttcaatacatattccgtgtccatccatctttctttcagagaagaatggcggctttccggctttttctcttgcctgtccttcggcgcccggatgcttacaagaggcctgtcgtgattctccatagcccaatactccaggaatttttttctgatttgttcccaattttcacaatattccatatctgctcctgtccgcgtgccgtgcacgctttccaattttaacagctgtgataatatctccttgcgtatgatctgctgttattctcttatttttattcctgtcatctgatattcggagggtgtacatccgcagaacagcttaaaccgtttgctgaaataatagggatcagaaaatccggtgagctcggctgcttccgcacatcgtatcccttcctcacgcagaagctccctcgccttttcgatacggatttcctccagtctctgcatgattgttttacctgtctgtgtcttataaacccggcggatataactgttttcgaaaaataaattttccgcgataacattgacggaaagggttccttcctggtaatgctcctgcagatactgttctattttattgaccagaatctccttcttacttcccaccggcacataagtgcagtccgaaagcatttcatatacataatttttaatgatttcctttacctgccccacggtaaaacagtcctttaaatcggttataatgctgtcctgcatctgcatgtaatcggaaatgggattttcatttgtctgtcggaaataagaatggatacctatcatgagggaatagtatacatttatgatatattgaaaagaaaacatctggttttccgacaggccgaacattctctccatgatatcatccaccttgggataatctctcaactcaaaatatttaatcaacagattgacatcctgggtactgtaaaaggaaacatctgtattaagggattttaagtcctcatagcaggccactctgcgatgtaccttggtgctgttttcatagacaagccgggcctgcctgtaggtttcctgaagatgatccaatccttcctccacacagcttaaagcggctgaatccagtattgcagcattcttatcctccagcaggctttcatatgccttctttatccgttccatgaccccttctttgttatccgtcacatgagcaatggtgacacagctgccgtcatttttcaggcaatagctgccaattcctgcccttcccaggtagaactccagcagttcccggatcacggcaatatcataatcaccacaccccttccggattcgcagaatagataccatataatggctccctttgcccggaagcccttccttccatatcaaaagctccggctgagcctccactgcatcccgcagcagcatttcctgcctgagatgtttgtttttccgggattcctcaatatccttgatgcatttttccagagcttccttcagttcttccttatcaaaaggcttaagcaggtaatcgaacacattcagcttaatcgcctgatgtgcaaaagaaaattcatcataggcagtcatgataatcacccttgtttccgcatcactgcccttaatggcttcacaagcctccaaaccattcatcctggacatattgatatccatgaaaacaatatcaggatgcttttcccggataagggcaagcgcctcctccccgtctttggcaaagccgcatatcccgcactgcagttcctcccagtctatgatccgggacagatactgcaggtatatattttcatcatccacaagaagaaccttatacttcatggccacctcttttcagatttatgcacaaggcaatgctggttccaataggggtatcatccagctggatacaagtcccctgtccataatacatctttagtctttcagatacatttttcagaccaaagctttccatggaatgcattttatccgcagaagaaatatcatccatatctgctcccttctgttctcccgacaaaatacgcctgaaggtttcccggctcataccaatcccatcatcaaccacataaatataagcccagtcatccaccagttctcccgtgaccagaatatgtccccttccatttttaggcttaatgccgtgataaatagcattttctatcagcggctgcagcgtcagcttcggtatcttaaatgcccgcagctcctccggcatttctatggaatagctgagactgtcattatagcgcaccgactggatttccagatatttctgcagagcctccagctcctgatccatccatatccagtccagccccttattcagcaccagcctgtaataatccgccagtaatttgatcatacggctggcatccttataacaatccatactgttcaggcagaaaatagtatccagtgtattatacagaaaatgaggtttaatctgagcctgcagaagcgccagctccaaccgccttttttcccttttttcattggtaacattttcaaacagctcccggttcatccgaaccatctggttgaagctggatatcaggattccttcttcattttccacatccgtatccggcagattttccggaagtgagtgagtaaatttgcgcatgtgctccgacaattgggaaataggccgggcgatgcggcgcgcaataaccgtactcaatgcgttaaagacacacagcagcagaagactgactatgataatgactattgtcatattatttactgccgataaagaagcttttacatccaaaactgtagtcagcctccaggtatcgtttacctgatagctccctacccgaaatcctgacattccctttttctcttccgcatggccgagaacctctttcgaataggcaaactgggcgtcataatccggagccgcacgcagtgcctccatagcctccctgtcatcactggacagaagcatgccattctggtcagtcaggtatatatccacctccggagctccatccttatattgataggtctcataaagcctctgttcatccagttccaaaatgatataacccacatccgaattactttccacatcccttaatacctttacataatgcaggttaaaaccggaaaatgccgattctatcttgagagagtaataccattgccctgtggtggtgattcccatttttccaaactgcttcaccagttccagatttccgtccgaactccggtaagaacgatttcgttccttttcatacatatcgccgttattatacagaactgcaatatgtcccacatccggatacaataaaaaactgttttcaataatattcagaatcttctttttcgtcgttgtattatacagattaggataaaaaagaggcgatccgttcaattccagcgtattattcaggtttactataatactgttgcagcagcttccggtattggaagccaggccggccatctgctgcacaatgagattatcctcatagctccttccctgcatgagcttttcatacatctgactgctgtaaattccccgcagcacaaaaataatacagatgaccagaacggtaaaaaacaaagtaaaagaataactgatcctctgctgaatcgacagattttttaacctctttttcatgcgtacccccactcatgtcttccctttattatagtggaagcttgcggcggttacaatccatctgtcaattcttcatgccggaatatgccatggcgtcacttaccttattactgaaaaaaatgtatagaataataacagggaaactggcaatgaccaacgatgcccccacaggtccccaatcggtggaaaactgtccataaaaaccggccagcccaaggggaagggttttcagttcatttttggtaatcagtatcagcgccagactgaattcattccaatgagacataaactgatatatgacaagaaccgatattgccgacttcatctgaggcagaataatactgaaataagtcctcataaagcctgcaccttccatataggcggactcttccagttccatgggaagtgtgaggtaaaatccgtaaagcaccatgaccccgaaaggaaaactcagagccgtataagggatgatcagcgaccataatgtattggtcagatgaaggttcttcaccataaccaccaggggtgtcataacagcctggattggtataaacatccccgccatcaccagggaatgaagagccttcgtagtacgcactctcactcttgccaccacataagtgaaggtaagacagaacagtatcccgaaaaacatagcggcaagagataccacaatactgttcctgaaataaagcggaatgtcaaactgcgttacagccttcacgtaattgctccactgaggcacaatgggcggcccgaaaggatttgttacaaaaatttcttcattatttttcagggaataaaaacccatccagatgacaggataaagacaaatgactgcataaacaatcataacgatatatacaagaaaccacgcaggcttaaaacttctttttttatttttcattatctgattcctccctttcgtggcctgtatctaatattgtccgtcaaaccgttccgtaagtttattaatccccagcatcataccgacacagatgattacaataaccactgcaatagcgctgccatatccatatttctgaaggccaaacaatgctttatacatcataataggcatggtatagctcgaattgccgggcccgcctcctgtcatcagaaagatcatctcaaatgcacggaagccataggtgatgcacattaccacacatacctttattgtaggaatggtcagcggaagcgtaatattaaaaaactgctgccgcttatttgcaccatcaatataagaagcctcataatacacatcaggaacatttttcatagccgcataaataataagcatatgatagcccattcctttccaggactcagccagaacaatagctatcacaccttttaccggttcataaagccagttttgttcccagttaacccccaaatgcctggcaagctggttaatgaggccaaaatctccatgatatacggaaatccacaattgtgccaccaccgatacggacagcagcacagggaaaaaatatacatccttaaaaaaacgtctgccctttatattgaaattagccagaaaaaaggcaaataaagtccccaaaccgatctgataaaccgttagtacgccggaatataacagactgttccgtatggaaaccttcagatctcttgacgtaaaaagccgtttaaagttatccagtcccgtaaatacggcctcgttcactccatcccattccgtaaagctcatagctgccgattccgccagtggtatgacaataatcagacaaaacagaataattaccggagccgtaaacagaaacattgccgccttcttttttcgaaataacggattcatttcctcaccctttcctttatggataagggggtacagtatgttcctgtccccctcccggtgtctcttcttattgaccaagcgcttcagctatctgttcatccagatccgcaatgaaatcttccggtgtaatcagtccggtcagaagcagttcacaggtatcttccagtgccactatcagttcctgattattcaatgaccattcaaattttgtggtagactgaattttatccagattgtctgcataatgctgataggattccgcccgcgcttccaacggttccactttttccttcagtacgcttaatgaaccaagttccgcattggcaatatcccttgcttccagaaagcttaaaaggactttcttggaatattccgcatatttgcctttggcgcttaccgcatagccgcccatggatcctgtaccgccggactctgtccagtgcgtttcctcctctttgccttcatccgtaaaaggattatactcaaaatatcctatcctgtcgccataaccgcctacagccgcgtcattgaaaaaccagcttccattaataagcatacctgcctgtccggtttccaccaattcaaaggcctggctcgcattggtattcagtgcgccttttccgattaagcccattgaggtcagttcactcagctttttggctgcttccagatattcctgatccgtaattttcgtgcttccgtcttccaaccctgtaagtcccaaaggctgtccctctgctaccacggccatatcaaacatctgaagccccggccatttctgctgggcaaacaatgccagagggattatgccgtctgcattcagtgcttctaccacagccttgaattcctcataatttttaggttccgccagtcccagcctttcgaatacttccttattgtagaatacttcacagcattccggaactgtggagctgatagcataaaaatggccatccgccgatttctttacatcaaaattcccatccagatatttatcaaaaaaccctgcttcttcaattgcagaatcaagctccgccagatctcctgatttaatcagaatatcagtaagctgtccggtacattcaaaaatatcaggcagttctccgactgcggcccttgtcttaagtacactgccgtcagaatccgtcctgtgttcaatattgatcttcagatccggataagtctccttcatgatttccagcgctctgtctacctgtgcaatggcgctgtctgcataataagtataaatggtcagttctgtgggaacctctccgatgtctgcctgagcttcagctcccgcaggcttttcttcctcactctgtgcttcctcattcgccgtcccggtctggaccggtttggattcttctcccttcgctgccccgccgcagcctgtcaggattgtggaaatagctaatcccaccgccagaacctttgctgtcagttttcttttcataccttctcccttctgcacatatgtgccctacctgccggaataaatgaaaaaacatactcttcatatgtactccggtaccctttttctatgtggcttcattttagcaaaatcattgactgcataaaatggattcagcgtgcctgggatggaatatttgtgcttctccatttcctctttgttttaagctgatatttcggatctcgtcttttgggacatataaaggaaccggccctatacctttttagatatagggccagatttctttgagtttaaaattgcatcgacgttttatcaagcagcgccgatatacggatgtcgatgtacgggcctgtccggattgttgccagtcaaatccccgtaggaataatacttccttcaaacacatttatatcttcttctttctccggaacagcattttcacaagctcccacacagtctccttcttctgctcatacctctttccgtccttcaccatatattccgcacagaattccccaatctcccccggcaccgcccggcagaaatcctttttcatcacacagaaatccgcttttttccccacctcaagcgtcccgctgtccttctcctccccaagcatcctggccggttcccgggtataggtgcacagagcctgataaggtgtgagggactgctgcggcagaaagaactccaccatgccaagcatctgctcatagggattcatggactgtaccggagaatcgctggatccgcagatgcacacaccggcctccgccagctccttcaggggaatctgctgctctgccttttccttcggaaggaactgctcatagcttttcagataccgtttgtccagccaggaaaaaccgggctgtaccgtaagcgccaccggaagcttttttatcttctccaccgcttcccgggaggggaattcgaaatgatcaatacgtgacaatggggcacccgcgccatccctgcgtcctgcagtctctttttccgcctgttcatagcagtccactatctggtcaatggccgcttcacctatagcatggctggaaagctggattcccttttgcctggcttcctttaccttgcttaaaatcagacttttctcataatagcaatgtcccttttctcccgtgtcccggaagggtacataaaaagcggcgctgtgcgagcctaccgaaccatcaagttcccagcttccgcaccctcctgccctgggatacttctgaagcctgcggaagggccgcgtgcgctccaaatccagatactgaggaaacaggcgtatatcaatatccatccgggatgcgataaaagccagcagcctggtaagaatatcatttttaacatcttcatttccgtccatggcgcatacacggctgattccgtaacgggcgcagagattggaaaaattggcaatcccccgcgcaagcactcccggggtgacggaggctgcgatgagattggttacctttccctgcataaactcatgctcttcgccggagaacctcccgtcatgcccctcacaggacaggcccagctttttcatcagcgctgtggaaatacagctgctgtgcccgtcaatattatagatgatcatacatctgccgccggtccactcatccagttcatgacggtccggaagtctcttttccttcatggcggaaagaatatactggtttgccgcaataattttctgtttaggatgcgaacggcagtaatccctgaccctggcttccactccttccatgctgtccggcacaattcccccggatgtcacctcacacagattaaagctggaggccgcaagaatcatggtgtaaagcagatgcacatgagaatcggtaagcgtcggaaaaacatgcattccttccagatcgacataatagtcatagcccttcagagtctctttctctgtgcttcctgtaaaaataatccggtcttcttctattcccagcgccgtaaaggtttcctgttctttgcgcatggtatggattgttccgccataatataatgttttcattttatatcttcaccacatttccaaccgccatcagaacataggcgattataatcagaatctgcatccatccgccgctccatcttccaagcagcgaattccccggttcccgggatgccttccggaatgcaggcaccaccaggagggcgatgaggatagcgataagcccgccggccagtcgcatgaattccatgaagcctccaagccccgcaaaagtaagggccagggacggcagcgtggcaatcacccagcaaagccttcttgacagcttcagctgttcttccacaatgtccgccagcgcaagggagatagaccagtaggtcgtaagcatcgccagaatggtaaacagggaacccaccatttccgcccagctgccgattcccttactccagccaatcatggcaacctccgtcacctgtgtggaggagagcagagcgcagaccgtgattaccgtaatcaggataaaattattgagaagccccagaaatacggcctttcgtacttttttcccatctccgcccaggcccgataccgcctgcggcacggaaaagaacgcggaaaaggcaaacatgcccatgccgaaataggccagtccttccgttatactgcccgctttaacgggaaggggattttgaatgtgaagcatggaaaaacaggccaacaggccgaccagaaggaaaataacccctaccgccagtttttcactcactcccaccgctttcagcccaaaaagaaccacactcgcggcggcagcgtagaacaacagccgggaaagccacagggatatccccagcagttcgcttataatttccgccgccccggatatgtaagcggccagattggtaaagagtaccagtgccattatcacgaaaaaggccagtgtcagcacctttttatattttccctgaaacagatatctggaaaagacttcaataatctgcgagcctccgccgctctttacggccagctccgctatcatcacatgaaggatgaagcttgccagaaaagcggctgccagaatgagcaggctcatgagacaaccgttcctttgggcaagataaggcattgccatcactcccccgccgattccataaccggtaataatacaggcgctttccacgatagtcaattgtttgtttttcattttctttccctccgcatactgttataaattgtaacatcgggtaggtagaaataacaagaaggaatgaagaaataaaaagaatggcatatctttctgccattctttcctttttccacgcaaaccctttttcttccatgatacttaagccagttttcctcccttacatctctttctcttctcccccgccatttctgtccacaaatacacagcaagccataccacgcaatgtacggataacagcaggatatatactgccggaaagcttcctccttccaaaagctccatgattccccggaatgccggaaccgacggaacaagacaggccagaccgtttcccctgctgcccgccggcagcagcagccaaaacagaatcggcggagcaataaacccgatcatcaccagctttaacagcccaatccccgccatcagcccttctgccgcccttccggtaaacgctccggcaagagacgccagaaatgccgataaaagaatgaccgccgtcagacccggcagctggatcatgcgcaaaggccttatacagacaagggcggtcaatccggctgaaaggattcctcccagcaggcccacggctattttttgaaacagataaaccagcctggaacggggaagaacgtcatttaccaaaatagttccatcctccttttcccccagaatattcatggcgctgaaggtacctcccataaacatggcggtcaccataattatggaaataaacagatttttcagcccggtatctccctccggtactgccatgcttactgataccgtactgatcctgtctctttcctcatacagcagcgacagtcggtcggcaagcttttgtatcatttcaggctcatccccggcacgggtaacagaaattcctcctccctgctgccggattcccagcacgctggtggatggctccagcacagcttccctcaattcttcctccgacagatactccttcaccgtccccagtccttccagccaatcccggatttccggcgaagttaagttctccttcaccacaccgaattccggctccgccaaatccagcaagtccacatcccccagaaaatttagcgcaatcccggcaattacgggcagcagaaaggaaagaatgcacatcttatcccgcacacagcttttcagctgataccaaattccacatcccatgccctcatccctcctttttcatttctgaattccaggcatacaatgaaagtccaaaaagtgcggcccatgcaagcaggcaggaaaacaaatataatccgccgcccgcctttccttcaaaataagcctgcttcatgcctgcaaaaatccggtatgccggattgtattccatccatttccattccacgccagtctgcccaaccagaaacaccggcgtacagataaaaatggccaggccgagataaaacagggaaaactgtttaaaatccgacagccacagcgcacataaaaaaccgatcagagccatgatacccgataatattcccgcctgtaccaatactgccggaagcacctgtaaagaagccgtcattcccagattgagcacggtaaacacgatagtaaatataagatcagccgccaagcatgcggaaagcttggaaatcaaaaagaccggccgcctcacaggaagagccgcataaagtttcattacgcccatctttttctctttaaaaagcagggccgccactccgagaaatcccaccgccgtcagttcaaaataaaggaactcgcaggttatttcccttcgctgtttcatttccttatcattatttcctatgatctccgcgggctccggcttctcatctgtaagcagggaaagggcataagcgccgcggaccgcatcaagctccctgctgccgctgctttttaaagaaagcgagggatttcccccttccatcaggattcccaccccataggcatccccacatttttcctccagttcttccctggaggataccgcctctatttccggtgatgccgttaccgccgttccttccggattataaagatacacaggaaaaatagcctgatccgtttttacatacaccagctggatatagcaggtataaaggagcagtgagacaagagccagcaggaaaaaatgtcccgaagccatcagccggatatccttccaaagaaacgccttccattcttttctcatcccgtaagcccccttccggtcgttttcagaaatacctcctccagggtgggctcctgggaatgaatactcacaatatcctcaggaaaggtccgccccagctcttccggggtgaaatcccgctgcaccctctccccgtccttacggtataccacctgcactgtttttctgctgtacctctccttcagactttccggcgtgtccagggccgcgatgcttccttccgcgagaaatgccacccggtcgcagagcaaatccgcgtccagcatattatgggtggtaagaaaaaccgtagtcccttttttcctttcctcttcgatgatctcccggaacagaacagcgccggagggatccaggccgctggtaggctcatccagaaaaaggatatccggattccccaaaagcgccctggccatactcacccgctgacgcattcccttggaataagaagccaccggcttcttcagataatccattttaaattccaggcgttccagaagcggcatgatatcccgcctcctttccggggaataaaaggaagaaaaaaacttcagattatccagtgcgctcagattcgtatacagatacggaaattcaaacaatacccctatttcctggtaaaatacctttctgtccgtcttatccggcgcttttcccatcagtctcacttccccctgatagcctccctgaataccggtaaggatcttctgggttgtggacttccccgaaccgtttgggccgaggaagccgaatatctctcctttttccacctcaaaatccaatcctttcagcgccttcctgcccttctcataggaaaagacgagatcctttacttctatcattcctcttccccccatttctttttcttgtcgtccggtttccgccttttcccccaccatcgcataaacaggactttaactgccaatatcacagctatccccgcaataatccctgcccactgaatccatccccatccgcttcctatcataactgcctccttttttctttcagaatctgttataagcttctgataaaagaatactaacggacagcgaaatccccatgggcgccatgtgaaatccgtgtgaaaataacgcttccattccccggaggtaatttgttcaataaaaaagcagcctgccctgccttaagtgatacactcgaggtacaagacatgctgctattttttatttttccgttttactccccgactggagcaaaaaagtaaaattccacccctttatctctgttccgaaccccatactcccagccatgcagttccagtattcccgccgctatcgcaagtcccagtccggccccctccgtactccggcctcccacacggtaaaatttatcccatacccggggcagatcctcctcccggatgcagtctccctcattataaacaccaaaacgtaaaaagccttcttccttttccagagttatccgcaggattcctccgggactcacatgcttcctggcattgccgataagattatccagaacctgctccatttttcccttatccgcgcagacctgatactccatggcaggaagccggtattccagttcaaattctttccgtggcagatccatcagaagccttccggcctctgtttccgtaaattccacaaatccaaaaagcacaggcgcaagctgtaccgccccggcatccatggccgacagctccagcagggaggttatcatacggttcatccgttccgtttcccctatgataacctgggcatactgctttcttttttcctcttctccggtatcctgcagaccttccgcataggcccggataacgccgagcggcgttttcatctcatgggaaagattatctgccagttctttccgctccgccacccttcttttttcccgttccacctctgtctcaagacggctattgaccgcctccagacgggaaagggcattctccaggttatccgccatcgtattcagattctgagaaagcatgccgaactcatctgtgctcttcagctcacagggcctggaaaaatccagccccgccatacgtcccgccgcttcattcaattcatccaccggcctggtgataaaacgacccagcaggtaatccaccagcaatatcacccccagcatcagcaaaaaccagataagaaaagcggcatcctgacccaccggcagaaccgatgtaaataaataaaaaagtacaatggctcctcccgccagcttggagaggaaaaatacccttttccggatagtatgcatgccgaaattatccctgcaccagttcctaagcttcataggcgcacctcaaatttatagccggaacgtatcagcgtgacaatccactgcccttcgcttcccagcttctgcctgagcgttttgacatgtgtatccaccgtacggctgtttcccgcaaaatcatatccccatatccgatccaggagctgttccctggtaaagaccattccgggatggcttaaaaaaaagaaaagcagctcatattccatatgggtaagagccgcctcctgtccgtctacatataccttacgggcggaaggcatcaaagtgattttgccggcgcttaaggcctccgcctccagttccctggcgcttgtcctacgcagcagggcattcaccttagccagcagcaccctggggctgaagggcttcgtcatataatcatcggctccgaattcataccccttcagcttatcctcctccgccgccctggccgtcagaagaatgatggggatcccgctccgttccctcaccagccggcagactgtaaacccatccagatgaggcatcatcacatccaaaatcagcaaatcagcgcaatcctccttcaagagggccagcgcttctatcccatcctccgcagtcacacagctatgcccgccccggcgcatatactccacaataatatcctgcatctgcttttcatcttctgccaccatgattctggacatagccgctcctatcctttattccctgcagaattcttcctgattataccggtaaatacaattccttcctgaacttttcgcacaataaagggccttatccgcatagcggatagcgttttaaagtgtaccccttgtcaaggacaaatttaagaagaagggatactatgttctgaatagatattgttatatttcttcttccttttctggttcatttattattcctctaagaggataatttccagttgttatatattggtaatactcatttggagatagctttgccaactgccattgatatctctcattattataataatccagccagtcatcaataattgttttaacctcttgaaagacggtgcaccggcttatatccacctcatctttcatatggccaaagaagctctcctgtggtgcattatcccaacagtttccccttctcgacatggactgtctcaatcctctatcctttactaattgaatgaaactacagcttgtataatgacagccctgatcgctatgaattatggcttcagcacttaacgacacaccgtgtttttctaccatccggtttactgtctgtagtacaaaatcaacttccagtgattcgctcaaaacataagacaatatctgttttgtaaaagcatctaaaattgtagacagatagcaaaatacaccattataagggatatatgttatatctgtcagcagtacccttctcgctccataagctgtgaattgtctttttaccagattgtctgcgacatgattggtctttattgcttttgccattcttctatatggatttgcagctcttattttacacacaagtccatactttttcatcaatcggcggatcttctttacattcataattatgggtggattttgatgtatcagcgtcatatagatgctctttgcgcccttatcatatccacgtttagcatacgctccaagaattatttcaaaatctgcctgatcttttaattccttcctctgtctttcatctgcggcccctgcccagcgatagtatcccgatcttgatactcctgctatatcgcaaagcattgtaactgataacagattatcttctttgcttactaatccgtatataatctcaaatttacagtccgattcattcatcatccgtctttctgctttgagttgtctgcttttataatttttttttaaaaactcaacctcctgacgaaggtatagcagctcatgctgcatctgatctaaggatacttctttttcatgatttgagtttattcgtttcatgggaactcttttggttcgattttctccctctgtaaatccatctccagatagcgcctgcttctttactctctgcacaatgctgtctatctgtttttgttgaaacagcttagtgtcataacctaaatcagctataatctttctcggggcatctccagcctggtatcgtatccagaaatcctctttaaacctggctgtgaaatacagtttgttctttgtgacattcagggtatacttattttccttaagttgcttcatctggtttactgtgtattcccgcatatctttctcctttagatgtttttattatatatcaacatctatcagagataaagaacccccttttcaatctgtccactttggagggggcatcccttcttcatagtgtccattttcaaggaacccttcttcttaatgtgtccacatctatgggtacattatattttcccccttctccaattcccttgtatttcccttccatatccctatacttaccgtgacctttttccagggggtatcctctcttggaatattggccgaatcgatatgtttcatcaaagcctcttccatccgtgattcttccccgggctgttttgaaatccgcacaagaaggaactcttccccgccgtatcggattgccgccgttccttctatctgttcatactcttccagaatatccgcaatttttttcaggcacacgtcgccttccagatgtccgtaggtatcgttatactgcttgaaataatcaatatccaccatgatcatttcaagataacagtccttattttgatattcttcaaaatgatccagaatcttttccattaagtaacgcctgttatgcaggcccgtaagctgatcggtaaaagccatctcatgcagcttgtcatttgctttctggattttcttgtactgcatggaaatgatttccctgtccctgaattccgcctccacgctccggttatagcggatggatatgaaaacggaaagaaaggttacaaaggtcccgtttattatattgccgaacaggttttcctggttaacaccggtaatgaaaaggagcaccaccacgactccccagttaatggaaaaaaataaaacgctttccaaaggctccattaacagcagagccgctatggttggtatgaggtaacagtatacgccgatagtattccctccaaattgctccagcatggtaattcctatgcaccagataaacaaaatacaggtataaacacgtctcagtataataactgagtgaaacctccccgatttaaccagatttatatagcctgtcaggaaaaagctcgtcgctatcagcagcatggaatacagcgaaaaatatcctatcctcctgggcgatataaaagggcctcccttccgaaaagaaaaaatcaatatcatacaggcctgcatggctataatgatccctgccatattccgctcaatacgaaacgcttttcttgtataatattcctcaaaccgttccttctgttccggaagaattatgggtttcatggtctgtctcagcttatccccatatttgcttatgttcatgcactgtacctcatatactgtatttgctttctttcatgatcctttaccgcccgtcgtctgcatcaagaagcttcccctgggttttaaggagttccctagccattagcaaaagaaaccgctgggtttccggaaccagacaattgaatatttccatgaattccttttcataaggagaatccagaaacatgcccccttctccggtaacaaaccatttttcatttacatgaaatgcagagcagattaccttcacatatttatcagacaacggacggtttccgttttctatcatagaatatgcggtctgtgtaatacccagatatttggcaaattcggtctgattcagccccaattccttccgcacttcctttaaacgatgaatcataaaatccctccgcatacgttgtaatattacgttatcacaaacaatataataaggcaagttataaaatcattccgcttttcccatattcttttaccatatcgcaggtcatatcaatcatctccgcgctatgggccgccgatacaaacatggcctcaaactgagagggcgccacataaatgcccttttccagcatccatccgaaatatctggcaaaagccgcggtatccgaggtcatgacactttggtaatccctcaccttttcccttgtaaaaaacggggaaagcagggaacccacacggttcaccgtaagtccgatttcccggtatgcctcctccagacgagccgccgactgatcgatctgcgcgtagatttccggatgggcaatcagaagtttcagcatttccgttcccgccgtcacagcaatcgggtttccggacagggttcccgcctggtataccgcgccgcagggggccacgcaggacatcacatcccggcggccgccgtatgccgccagaggcattcccccgcccacaattttaccgaaggtggagagatccggcgtcacgcagtaatagccctgtgccccgccgagtcccagacggaatccggtgatcacctcatcaaaaatcagcagtgccccagatgcatccgccgcttcacgcagtgcggcaaggaaaccctcctccggaggaaccacacccatgttagccgccaccggctccaccacaatacaggctacctgccccgcattctcttccagtaatcttcgtaccgattcgatatcattgtattccgccagaagtgtcgccgcggcatagcccgcgggcacgccggcgctgtccggcacggatccggtcagcagcccggaacctgccttgaccagcaggccatcggaatggccatgataacagccggtgaacttgattattttttcccttccggtaaagcccctggccgcacgcaccgcactcattaccgcttccgtaccggaattgacaagacgcatcatttccatagaggggacgcaggattgtatcagctgtgcgagctccacctctttttccgtaggcgcaccgaaggtcagtccgttttcacaggccttctgaactgcctccaccaccgaagggaccgcatgtcccaggattcccggcccccaagagcatacataatccagataccggttgccgtctgcatcataaagataggcgccctttgccttttccacaaaaaagggagttcttcccaccgaacggaaggcccttacaggactgttcactccgcccggcatcagttttcccgcccgttcaaataattcttctgattttgtcaattttgtttcctgcctttccatttcgtacagtgtccatcctctgatgccgcgctccgctttattcccgcggggtatttgactctgccagccacttcgccatatccagcgcatgataagtgatgataattttggcaccggcccgtttcatcgccgtaagattttccgtcacaatccgtctctcatcaatccatccgtttgccgcagccgcttttaccatggaatattccccgcttacattataaaccgccagcggaaggcttaccgtcatggccgcctctttcagcacatccagataggcgaggcccggtttcaccataaccacgtccgcgccttcctggatatcggaataaatctcacgcagtgcctcctgcccattggcgaaatccatctgatagcttttcctgtccccaaacccgggagcagaatgggcggcatcccggaacggcccataataggcggatgcgaatttagcgctataggccataatcgggatatccgtaaaaccgttctcatcaagggcttctctgattgccgcaacccgtccgtccatcatatcggaaggcgctatcatatccgccccggcttccgccagggttacggacatcgctgacagcaggggaagggtttcatcattcagaatttttccgtcctttaccacaccgcagtggccgtgggaggtatattcacaaagacacacatccacgatacaataaatatccggataatttttctttatgtaagctaccgctctctgggtaatcccgtccctggcataagcctggctccccatctcatccttgcaggcggggattccgaacagaaggacaccggaaataccgcttgccttcacttcttccatgatttctcccaggcggtcaatggaatactgaaaaactcccggcatggaagccaccggattttttatattttccccttcgatcacaaatatgggataaataaaatccgcgggatgcagccttgtctcccgcatcatggaacggattgtctcatttttacgaagtcgtctgaatctttgcatcctgctctccttttacggctcttcccgggaaatttacgcgtctttccccgtccgtctcgctttttcttcgtttattacacaccttaccaatccttcggtggtaaactcctctgccacgagtgtaccaccggacaaaggattccgcaattgaatttcctgaagctttccggcacatttttccccgatgcaggcaatcgttacccgctccggcagctccgtcttctcttccagcagcccgtcccggaaggtttccacgcccgacgcgctcccaaagagcagataatccgcttccgccgcatttctgaccgcttccctgcgtttttccctgtccgcttccagttcatatagggaaaaatccgtataggaaattccggcctgctccaggttccgcgtcagctcccggctccctttatctgcacggcaaatcagtatcttttcctctttttccgccagggaagccactaaaagccccagatgatccgcatcataaacggagggcatggcatcagcataaaaaccatattcctcaaggcggctttttgtacccggcccaatgacggctatgcgcattcccgatagtgttctgagatcccttttttcttcacgaagtttattgaaaaaatgcgccacgccattggggctggtaaagcacagccaggagtatccatccaattccggaagtctctcttttgtgggaacggcacgcagaaagctgcagtcgatcacacttgctccctgctccttcagcttttcagccagacgggcggaaaatccttccgttccggtcaccgcgacgcgcaggcccgccagttctccctgcgctgttccggcagagaaagaaagagcggccacttccccgatgacaatgaccgcaggcggcttaaggccggctttttccaccgcctctgccagtgtttccagggtcgcgcggacactgcgctgtctgtcggtggctccatccatgatcactgcagccggcgtatcccctctttttcccgcctccatcagctttccggcaagctccttcaggtgatgcattcccatcagaatgaccagagttccttccaggctcgccagggccttataatctatcggcgtgagggactcctgctttccttctccggaaacagaggaagcggtaagaatcgtgaccatcctgctgcactgcctgtgcgtcaccggaattcccgcggatgccggtgcggcaatggcagaggtgatgcccggaatttcctcgcaggcaatcccttcttcctgaagcgccagcatttcctcgccgcctctcccgaatacataagggtctccgcctttcaggcgcaccacaacctttccttcttttgccttttccagcaaaagcctgttgatctcctcctgaggcatggcctttccggcatacctcttccccacattgattttttcgcaggacgaaggcgcctgttccagcagctgtgccgccgtcaggctgtcatataacaccacatcgcaccggcgcaggcacgcaaggcccctgaccgttatcagatccgcttctccgcagcctgcgcccaccagatatacttttccttttttcttctccatcagagttctctccgtatctgtaaggaaagagcgtccgccagggccagccgcgccttcactcccccttctccctgtacctgacggccgccatacatcaccgtcagccggaacctttccgtttcttctgttttttctgtcacgctgtatgccgcagccggctgactgcagtccgcctgcaggacctccagcacacgccgttccgcctcaaaagaaagcaggctctccctgtggcaaagctgcgctacagcctccctgtactcccagtccgaccggccttccacggcaataatcccctgacaggcggcgggaagaaaaagggacggctccagcggagtaaaggaaaaacgctccttttctttctccataatacccagacgatccaaaccggccttggcaagaataatcccgtcatactggcccgcttccagcttggagaggcgcgtttccacatttccccggatcagctccacccgggcctgcgggcagagctccttcacataaagctcacgcctcttgctgccagttccgatgacaggccggggcggaagacttgcaaagcctgcttttgccccctcaggcccggtcccttccgaacctttttttctcacctgtaccagaacatccctggcatccgctctttggggcactgccaggatttccagaccttccgccagacacatgggaagatccttcgcactatgtaccgctaaatccacttttttttccagaagtgccgcctccagttcggaaacaaacagccccttgtccccgatttcccccagcggcttatccaggattctgtcccctctggtttttatgatcaccgtctcaatcctggcatccggcaggcaagcgcgcagggcgtccgccaccattccggtctgcaccagcgccagccggcttcctctggtaccgattctgatttccgtcatccttttcctccctttgcaggcgccgatgcttcaagaagctctgcaagatatgtttccagctccggttcttccgccttgaaatcccgctttctgcaataaacaaacagagcctccagacatgccgcccttcttttctgttccggcagaagctcaagcaccttctccctcagccttcccagtatttctatggtattccccaggccctccggcaattcctgttccatcgtttttcttacaaaagaagcggcggccgggctttttccgtccgtcgaaattccgacggtcagcggcccttcctgtatcagcgccgggaaaaagaagctgcacttttccctgtcatccaccacattcaccgggatatgccgctcccggcaccaaccggccgcccaagcgttgacctcttctttatccgtagccgcgatgacaaagcaggcgccttccaggtcttcctcacaggcttccctgtaaacaaaagtcaaagtctcccccgaacgggacagctgctccagttcttcttcgattgccggtgcgatacaggtcaaaaccggcccgaaaggaagcagcttctccacctttcttgccgccacacgtcctcctccgagtataactcccttttttcccccgatttccataaaaaacggaaaatgtcccattatttcctcccttcccgcaaaaagccgccttatgcatccgcttcctgcagggtgtccttactcctgattctcttcacagactttcagaaccgcttcaaaagacgcggcatccagcttatcccgcaggaaatacaggattttgtccggcccgcagccggcgaacctttccttccatgtatccagccttccggcagcatcatgaaaggccagcgtcttgtacagggtatccagttccttagccatcatttcccctgcatccagaatggcctgctgcttgcggatgttattcctgctcgcaagccgttcgaaatcatctatggatatcagccggcagccgggaagggttccgatatccttatccatatccgcaggcacggcgatatcgataaaaagacgttctctgccatccgccagataaccggctgcctctcctgccgtcagagtatagtgagggctttccgttgcggagatgatcacatccgcctgctccagataattatagcgctccccatactccaccacggtaagcgctccttttgcactccccgttaccgcatgattccttttggttgcgagcacatggatatttccgtgatccatcagatttttaagaataatacttcccatttttccgcttccgccgatgagaagtacccgaaggaagctgtccgtcctctggttttccacgcctggcagccctttttccgtccgccccggcccgctctccgccttaaatacctcattggaaaccagagtggcaatggaaacggaagctttggaaatctccgtttccgtcttgatttttttagcgcacgccaatgctccctggaacgccgtattcagctcataccccggttttccttccttacaggaaaataaataagcctgccgcatctgtcccaggatctcgtcctctcccagaaccatggaatccatgccgcaggtaaccctgtataaatgctccagggcctttttcccctgaaaccgtctggaaatccggcgcagctgtgtttcttccataccgctcttatccgccagcagcctttccagcaaagagaaactgttttccccgcccgtcacatagatctccgtccggttacaggtattgagcaccaccgcctggcctgtctgctccagaattttccttttttcctcatcggaaaacacaaaacattttctcacttcctccggtgcggatttgaagctgatgctgatacattccatatttcctccattatgccttacatagggcatggattttttttctgaaagttagtttactgctcctgcccattggcccgcggtaccggctgcctcgcggctcagtccggcttccctcccggtctttccgtgtggaaggctgctctgcaaggatttctttaagggccgtataaactcgccggtccttaggctgcgtactttgcagccttagtaccgctgcgtgtttatccgagcgaaagcaaaacgactaaaagtcgtttgccctataaggaaccttgcagagcagccttccacacggaaaaaccgggagggaagccggactgagccgcgaggcagccggtacagcgggccaatgggcaggaacaatctacatgaaccaaggtcaagcgcgctgacgttagcttgaccttggcctttttcttattttctcattatgacggcgctcaccctagagcgtgtctgaaaattgctttccgtcagatgtgcgtcacactttgtgggagatttggttccaatgagggaggcgtagcgggctacgttgaccgaattggaaccaaatatacctcaaagtggggcgtacagatggcgggaatgaattttcaaacacactctagcaggtagctccacccttcagatgcaggctggctccgacgatttcctcttttctggaaaggatctcatctcccagcagctgctcctgtaccttttcaaagccgattctgctcaccgtatctgcaaaacgctctcctgtatttccctgttccctgaaaagaaggatcgccttttccagaacggaaagtacttcttcctcactggtgaagattctgtcaagcgcctgtccgtgcgcggttctctttccccagcgcccgcctatgtaaaccttatagccataggttccttcatccgccgcatggaacgggcattttccgatacagcgtccgcagttattgcacttttcttcatcgattaccagcttgccgtccgtaacctgtgcggcgcccataggacagatatccgccacctggcacttggcacatccgcggcagctatctatattataagtgggaatccgctgtccgacaataccaaaatcatttaaatccggttttacacaattgttggggcatccgccgaccgcaatcttgaatttgtgaggaagcttgacctcataataaccgtgatagaaacgttcatgtattttttcggagagggagtaggaatccagctgtccgtactggcaggttgttcccttgcaggcaaccacaggacgaaccttggaacccgtaccgccggtttccagacctgctccggccaggaaatcccgaagatcctctattctttcataaggaacgcccacgatttccatggtaagtctggtggtcattaccacgtcaccgtttccgtaaagagctgcggcatccgcgatacatctgttttcttccgctgtcaccttaccgtttcttgtaatgacgcggacattaaaattattggttcccttgttatgcaggcatcccagcgcctttacccgggtaatatcctccggcgacaccgtcaccttctccgccgtatttccggtgcgtattatattaaagaaggaagagccctccagcaccttcgtattggtataaccataatgctttaaccggttctgaagcagatatgcacgttttcccttggcacagactaacagcagcttttcttcctttcccataccaaagaagccctgttggggcatttctccctgcaccttgttcagatccacataagtgacgccgggaatggtcgggcctgcgggattgacatcaattatgcggtaatccgctgccgcgccatccatatattccgcaggagtgaagctttccatcactccgtccagcttattcttcaggatctgcactgccgtaacaaaaggatggatggctgtggagaacggcggcgcataagccagatcaagggaggtcatctgatccagggttccgccgaaggttacggccatcactccgatatccgtcatcttatccacggctccgggccccagcacctgaattcccagcagcctgcgggttttcctgtccgcgatcagcttggttacaaagaaagaggcatcgggataataatgggctttatcatcggttacggccagaacggtttccacatcataaccggcagccctggcagcctcttcagtcagtccggtacggcctccgttcagcccgggaagcttcacaacacctgtcccaaggacaccgggatagctcacgtcctcaccgcccagcgccagagccagggtacgtccctccatattggcggaagagcccataggagaccactgtctttcccctgtcatgcggttcgttaccatagcacagtcccctgccgcatatacatccggaaggttggtgcgcattttatcatccaccaggatagtccccttaaacatctccactcctgcctcctggcaaaaacctgtattcggacgaatccctatggataaaatcaccagctctgccggcaaaaagcctttatcggtttttactccttccgccttctgcgatccggtgattccctccagtttcgtagaggtcagtacacggattccttttttctccaggtgacgcttcgcataatcggccatttcccggtcaaagcccggcattatctggggcgccatatccattaccgtaacggaaataccctgagccagaaggttctccgcaacctccaggccaatgaagcctccgcctgcgacaaccgcttttttcacctgatgttccttcagataatctcttgtttcaatcgcgtcctccggcgtacgcatggtgaatactccgggaagccttaccccttctaacggcggaaccacggaagaagcccccgtcgctattacacaggcatcatattcataaatttcttccgctccggtacgcagatttctggcaatcgccttcttttcatggctgtcaagtcctgtaacctctctctctgtctgtacaagaactcccgtcagcgcggcaaaccgggccggcgtattcacaatgagctgatcctttccttcaattacttccccgatgtaatagggcaggccgcagcctgcataggaaatatccctgcctttggttacgatggtaacctccgcttccggcatcactctcttgtatttcgccgcgactttggttccggctgcgacccctccgatgactaatagtttcatgctgatttctccctgttttttcttatatgtaatttccctgccccatccgcaggcaacgggccaatatcaggcaaatcgaaatgcagtctgacattgacccgggcagtagtaccttaatgataatctattttatcaataaagtgaaataatatattaattggtacccataagataaatttatccttaccatttgcgggtccggtgcagccggccttatggttctgccttgtcataaatacagcggacccctctatgcttctgtattcctcccagacattctgtattacagcggatacagcggcgaatgtttcctttctgtccgctgcgcagcttatcaggccaggccggatcggcaatcagctggcggctcatggctgcataggcaatgcggccatcggcaagctgctgctccacaaagtccggatccgtcagcccgcccacaccgcataccggcagcttcgtaattttccgcacacagtcacaatagcgcagaaaacagccttcttctccaaaataaggatgactggcaggcggtatggtatccgtaaggctggaatgatccgccaacgccacatgaaagctgttaacccctgccttttccagcatgggaataaatacagggagttcttccgttaatatgcctgcattcccgtaatgcggattttcctgacgtaccgcaagcttatattcaattgtcatatccggcagcgcctgccgtacggcggataccgcttccacggcaaaatgcgctctcttctccggactgccgccgtatgaatccgttctttcattatagataccggaggaaaaactgccgcacatacgatccccatgtatctggatcatatcgaaccctgcctgctttgccaggacagccgctttcccgaaggacgacgtaatggccgataccttctgagaggacagctgtgtaatatatctgcctgtctgctgattcagcagacgacggagttcctctgccgtaatctttttggtgagcaggccgggaatgtatctgagcattcctttcacatcgctgtccgactgatgaagctgggcacatgccagactgccgccggcatgaatcagctcacacagccgcctgtaatgggcaaatccttttttaccggacaggctgaaaaatcctctgtccgacaccgggacatcgccgataatgatcatggcgcagccgccctctgcgatagctgtaattttctgctccagctcctctcccctgagccccagtgaggtcggtgcaaaaacaatacggttttttaaggtaagtccgccgatttcaacagggctgagaatcgtttcgtacacaacaggtcccccctttttccgtatgcagcttctgcagcaagcccatcagctgttcctgttctttgttggtaagtcccttcaaagcttctttatcccatcggaaaaataattcatggctgaggcggaatgcatcttcccccttttttgtcagatgaaggatatgggcgcgcctgtcgtgagggttctgctcctgtatcaggaacccgtcctttatcagcttatttatggaccggttggtatgccctgcatccatgcggagcgcctgtgaaagttctcccggggcacaccccggatgctttccgacatacaggataaaatagagctgtcccggggacagtcccgcccctgaaagctgattgctgcaatactctgtgaaatccttgcgtaatatgctcacgtagtaagcgaatgactggagcatggcaatacctcctgttacttgattaagtcaagtatattcccgatgtttgacaatgtcaatcttttctcttcttaactggcagaacgcaatacaggtaggtaatgtaacatttgttcttttatctgtcctctaacaaaaaatccccattgaatatcccctgcggtaatagtaaactatgatcatatgaaaatcttcctttcacaagggcataaataaaaaacaattgtccagatcataaacccactgcttttccgaggatgccgactgctgctccgtcagcctgttggcattacctcatgaaaataattaatatacttataggagaaaatactatgaaatacgattttacttccatcattgacagacagggaaaggattccatcgctgtagatgtcatcccttttgacaacgcagaggtagcggagggcttctccaaaatccccatgtgggttgccgatatgaactttgctacggttcccaccatccaggatgccatcatagaacgggcaaagcatcctgcttttggctatttcgatcccagagaagaatattacggcaaaatcatagaatggcagaacacacgcaacggtgtggaaggcctgacaaaggatgctatcggttatgaaaacggcgtgcttggctgcgtctcctccgccgcccaggccttcagcgctcccggagaggccgtactccttcattcccctacctatatcggcttcacccatgcgctggaaagcatcggccgcaaaatcatcttaagcgacctcgtacgggatgaagagggcatctggcgtatggactatgaggatatggacaggaagctgaaggaaaaccatattcatttcgccgtattctgctccccccacaatccctgcggacgtgtctggacgcgggaggaaatcgaaaaagcaatggaggtttattccagaaataactgtgtcgtggtttccgatgagatatggtcggatttgaccctcgaaggacataaacacattcccacccagtccatttcagaagatgccagaaacaggactatcgcggtttatgccccttccaaaaccttcaacctggccggcctgattggctcctatcatattatttataacccctatctgcgtgaccgggtaaggaaacaggctgagctctcccactacaacagcatgaacgttctgtccatgcatgcccttatcggcgcctatcagccggaaggccacgaatgggtggatgagcttcgccatgttctcacggaaaatgtggaatatgcctacagttatatcctcgaccacttctccggtgtagaactggctaaaccggaaggcacctatatgctgtatcttgactgcgaaaaattctgccaggagcatgacatgtctatggatgaacttatccgcgccggtatccgtgtcggcgtcatctggcaggacggccggcctttccacagaccttatgccatccgcctgaatctggcgcttcctcattctcaggttgcggaagccatggcacgtctggataaatatgtttttaacaaataagcggttgattacagcttatttatagtttataattatttcaggaaaagaatattttatgacactcctgctgccagccaagatatttcatcagaaatatgcgcactacgcgcagagggagcagtcatgaataccaaaacaagttttaaagagctgaaccttaataatgcttttctttttgctcttgccctgagcgatcccgaactatgccgaatcattctggaattgattatcggaaaaccgctgggcccaataaaagtggaaacggaaaagagtattatgttcagctctgatttcagaagtatccgtctcgatgtctatgcctcggaccagtcacacgttgattatgatttagaaatgcagaacgagggtgacaaagacagtcttccgaaacgcagccgcctgtatcaggcggaaatggacgtgaagtccttaaatcccggagatgattttgtatgtctgggaagcagttatattatttttatctgtacctttgatccttttgaagatcagctattccggtatacctttgaaaacatttgctatgaaacaggaaaacctttgaatgacggtacctgtaagatttttctgaataccaggggaaccaatcattcggacgtatctcccgtattaatccattttctgcagtatgtggagaattccacggatgcctttgtggaacagatgcaggatgatacgctgaatcagattcaccggaaaatcagtgaactgaaagcaagccgtgaatgggaggcgaagtacatgaaatttgaagagctgttgagacgtgagcatgaagatggtgaagctgccggaacagcaatcggtgaaaaaagaatggctgatctcatttcattcttattaagagatggcctggaatatgagattcccaaaatcgcggctgatgaaaagcttcgggaaacctattatcacaaatatcaattatagtcctaatcttgacaaactctgcgggccggcctcagacaccggcctgtcataaaaatctattattcattatttctcaaaatatcaataaaaccaatcgatgaattttctctgtttcgcggcaataagtttacataaaatattcttttccaatctgtttttgtttcatctcatttgcatcatctcctttttgtcaatagaatggtaataataaatgctataaaatcagaaatcggcgctccaatccataagtctgtcataccaacaaacaggataaatattggaggaagccatcaaatggacatgcaatcccctccgcttatcccggtgcccgaaaaaataaagaattcaacgaaaaaagccggcgttttcgcaccggcctttccaataacatattactattcttccgtttcaatccttatgctggtcattaccggcatttccaacggtttattccatgattccggcccatacgtgggaagatcggcaatccgatccaacacctcaaaccctgacacaagctgtccgaaagccgcgtatcggccatccagcttatgggcatccttatgaaccacaaagaactgcgttcctgccgtatcataggcatcatctcttgccatggaaagcgcccctcttttatgaggaatcgggttaggaacaccattttccgcgaattctcctttgatatgccattcactgtccgtcatgatatcattatccggagaacctgcctgtatcacgtaatccttcacgatacggcaccaggccagtccgttataaaagccgctgttcaccgtgtccacgaaattcttcaccgtaacaggtgccagcccgggatacagttcaaataccatatccccgaagccttctgttgtaataatacatttcaaagcctgaatcctctttttctttcaagcaggcataatcaccttattttgcaagcacctttgcatttttaaagtacaggttgcctgaagatgtcatatatacgccctggacataatccttcagcagatagttgtttgctttgtagtacagcggaacaaccgggtattcattagaaacaatatcatccgcctgttttaccagttcaccggcttttaccccatccttttccacctttacctgatccactaccgcatcataatcaggattgctgtagaagcagttgtttgatacaacatccgtgtaaagcagaggaaggaagctcatgggatttacataatcggcgctccatcccattgcgcatacttcataattgccgctctggacatcgctgtagaatacggcccagtctgcagaggttacttcaacggtaattcccagattctgttcccacatttctttgatagcttccgctaccttcttcacgttatcatcggaatagaaggacagctgaagtgcagggaagccttctccgtcaggataaccggcctccgcaagagctgccttcgccgcttccgcatccgccgtaggtgacagaccgaaatcactgcgtccgtccagaatgtctttcccgtccaccacataaccgggagacaggaagctgtatgcaggttctgcgtctgtctgaaccacattgttgatcagcgcttccctgtcaatcgccaggcagagtgcttttcttaccagcgggttatcatagggtgcttttgcacagttgatattataatatacggttccgtagctgggggttgatttaagtcctgcattttcagccttcaggcgggccatatcgctggaaggaatgcttctcacgccgtcaacctcgccgctttcataagcggtcagagctgtcgcaacatccaggatataacgataggtcagtttttccagcgtaacattggcagcatcccaatagttttcattcttttccagaacaatgctttcgcccatattcatctctgtgatcttgaaggggccgttgcagacataggtgtcggcagcattggtccacttatccccattggcttccaccgtagcttcctgaacagggtaatatacccacatgctcacaagatccacataataagagcagggggctttcagggtaaattccagtgttttgtcatcaagggccttaatgcctacatcctctgcctttgccgttccgtcatagtattcctgtccgtttaccacataatcggaaatcatgtccacatactgagatgtggtttccggagtgaggacacgaagtgcggaatatacgtaatcgtttgctgtcagaggtgttccgtcactccatttcagaccgtctctcagatggaaggtatatacggtcatatcatcattgacgtcccaggattccgcattgcccggtacgacttcaccgctttccgaataagtaacgagtccttcaaagcagttcacaataaaggggactgcgaaagagttgttggtgatgccgggatcgataccgtccggctcgttattgagtacaaaggtcatttcctgtgcgcctgcagcctcttcaaccgctcctgcgctttcctcggaagcagttccttcttccgcagcctctgttgacggcagcggagcaatggtctggagctctccgctgtccgatccggatccacagccggacagcacagcagtacacatcaggccaagggcgagaaacagacttaatgctttctttttcataaaatatttcctcctcatggataatttatgcttcaggcatgatatagtatcataccgaaaaacctggttatcagccatacagatggcaggctgtcatatgcccgtttcccgcatctttaagctgcggcacctgttcagaacagatgtccttcgcataagggcatctggtatggaaacggcagcctgaaggcgggtcgatggggctgggaatatctccctccatgccgctcttttctttcattctggccagtttgggattggcaatgggaatgctgcccagcagtcccttcgtatagggatgcagcgggtttttatagatctcattcgattcgctgacttccaccagctgccccagatacatgacgcccacatcatccgatacatagcgtaccatggaaaggtcatgggctataaacagataagagactcccttttcttcctggaaatccttcagcaggttaactacctgcgcctggatggatacgtcaagtgccgatatgggctcatcacaaatgaccagatccggctgaagaatcagcgccctggctatccccacacgctgtctctgcccgccggaaaactcatgggcatacctgccgctgtgctcctttgtcagccctaccctctccagcatgggataaatgagttcgttggcatcctctttcttcctgacaacgccatgggcaatcaaaggctccgcgatgatatcccggacagtcattcttgcatttaaagaggcataagggtcctgaaaaatcatctgcatatttttccggtaaggcttcagctgcttttgcttcagttccgtgatatcatcaccgttcaaaaggatctgtcccgatgtaggggcgtacatccgtataatagtcctggcacaggttgatttcccgcagccggattctcccaccaggccaagggttttcccttttttcaaagtaaaactgactccatccaccgcatgaacgatctgctttgatcccactttaaaatgtttggtcagattccttacttcaagcatgttctgttcgttcatcatctgttccccccgcgaaatggattgtgttcatctgccggcgcgtcctcatactgcagaaagcacctggtccggtgcccttctcccacttccacaaaatcaggaagagaaccggcacacacttttctggcataggaacagcgaggagcgaacggacagcccgcaggcggattggtcatatccgggggtgaaccgggtatgggctcaagccgctcacttttttcctgctccacatcggggatcgaatgcagaaggcccatggtataaggatggccgggccgttcaaaaatatcttctatccgcgcttcttccataatcaggccgccgtacataaccagcaccctgtcacacagttcagccaccacgccaagatcatgagtgataaaaataatgctggcgccatattccttgtccagctccctgagctgtctcaggatctgatcctgaatggtcacatccagcgccgttgtcggttcatctgcaatcagcagctctggtttgttggcaagtgccatggcgatcatgacacgctgccgcatcccgccggaaaattcatgaggaaagctgtggtaacgcttctccggctcagggatacgcactttagcgaataattccataacctgagccttccgttcctctttccccattttgggatggtggatcttgatcatctccgaaacctgttttcctacgggaatcagcggattcagtgaagacatgggatcctgaaaaatcatggatattttatttccgcggatttcgcggagcttttttttcgatactttggttaaatcctctccttcaaaaaggatggaaccgtccttaattcttgccgtatccgccagaagccgcagaatggacatggaggtcacactcttaccgctccccgattctcccacgattcccagtatttcacccttaccgacgctgaagctgacgccgcgtactgcctgtacctcgccgttgctggtcagaaaagaggttgttaaattctctacctgtaatattgcgtccatgatttcacctcttattttttcagtttcggatccagcgcatcccgcagcccatcgcctacaaagttaaaagcaaacatgatcaggcagataacaagagccggaatgaacagctgatgaggacaggaacgaaggttctctgtcgcgtcgttgcacatggttccaaggctggcaaggggcggctgcagcccgatacccagataccccaggaaggcttccataaaaatagcggacggtatcagcatggttacggtcaccagaatggaacccatggcattgggtatcagatgggaaagcaggatggttttggtggaagagccgatggttttcgcagcctggacaaattcctgctccttcagcccgagcacctggccgcggaccactctcgccatatccacccagtaaacggtccccagggcgataacgatactctgcagccccgagcctaaaatcaccatgatcagaatgacataaagtgtcagcggaatcgtgctgatgatatccacaatacgcatcatcacagcatccacatttcctcccagatatcccgaaataccgccgtagagaaccccgataaccagattcaccgccacggcgacaaaggcaaccatcagggaaacccgcgtgccgtacatcagtctggtaaggatatccctgcccagattgtccgttcctaacaggtatgatttattccagatatttttcgatcggtagatcgtattattttccggattagctatcacatacggcttctgcccataataaagcgccacttccgtcccgttacagtcaaaaatcgtcatcatgcgttcggattcttccctgacttttttcagctggatgccgagcgttccgtcactgttcacctgaagcaccttcatcgcctgtgtgatataaagataaccggtattgtccggcgtttcataaaccttcatccggggaggaatgttcacaacctccaaatcctgcaccgaataactgtattttgtaaaaagagggccgaaggccgcgaataatatcaaaagaagaatgattacaaagcccgcaatcgaagtaggcttatggcggaaccggaaccatacatcccccgcaaaggtcctgttctttgtccatattttttccctgtcctcattggaggactccagcatatcccatttgttgtccatgacttactgctcccatctctgcgcccggcgctgtcgtctttatccttgctaatctttttcagtcgtacttaatcctggggtcaatcaggcagtagaatatatctacaataaaaatcatcgccatcagaaaggcggcatagaaaatggttactcccatgatagtcgtgtaatccctctgagacacgctgttcacaaaatgaacgccaagtccgggaatcgcaaagattttttcaatgacaaagctccccgtcatcatattcgctattgtggggccaagtaccgtgatcaccggaatcagggcatttctcatggcatgcttcagaatgacgctggtctctgaaagcccttttgccctggctgtccttatgtaatcctggcccatgacctccagaaggcttgaacgcatcagcctggccatatagctcagggaatatccccccaaagcgatgacaggaagaatatagcccttccagctgtcaaggccgaaggtgggaagccaattcagtttataggagaaaaaataaatcagaagagacgcgataacaaaagaagggatggtcacaccgatggttgccagcgacataaccagcatatcctgccactttccgttcttcaccgcagctaaaattcccatgggaacagccgccagcatcacaaaaataatagtgattccgcccagcttcgcggataccggaaaaccgtttttgataaattcactgacctcttttccggtatatttataggagggacccaaatccccgtgaaggactccgcccagatattcaaagaactgtaccggcagcggcctgtccagatgatatttctcattcagcgccgcttccacttcctccgataccttgcgatcactggtaaatggaccgcccggtatggaatgcatgatgacaaaggtcagcagtattatcaggaacattgccaccagcatcatcccaaatcgttttgcaaaatagcgaaccatatttcttccctctcatatccctcattttttgggcttaccttctgccttttccgtcactggcagtcacttgtactcccttaaaacacattgaaaattatttaaggtcgattataaacctgcggttctgcctctgtcaatgtttttctgtttgcctcagcccatcctctatcttccatttctgcttttccctgtacattatcgttacttttaagcctctatgtaacctctttatttttcgtttccggaacccaaaataataaaaaaaacggtcccggaccagaggttatttactcgttgaaataccactgatccgaaaccggttcttgagaacggctcccttttatctgttgtatatgcttccgtcacagcacggatgaaatgtctctccgaagaagctcctgcgccttttccagatccttatcgcacaaagcctgataaattcccacatgaggctctttatcaagctgatcatccatgctctgctttttattccaggaaaactgcgcataaatcctcttctgaatgctcaggctttccttcaggaacttattcagcagctgattgtccgcataagatgcgagaagaagatggaacgcttcattgtcttcccataccttccagacatccaccggttcctgctgcataagcgccgcattatcaatatgccgtttaatatcctccagatgatattggacgatcgcatcaaaaccgtctttcaatgcctccagctccagaatgcagcgcagcttcaggatgtcccgtgcatccttttccttcattttaaccacaacataaccataacggggaacattcctcagcaccccttcgctgcacagctttatcagggcctcccggacaggagccttgctcacgccgaacagctccacaaggcgtttttcattcagcacctgctcctcctccgaagcattttttataataagctccagaatttcatcgtgaattttttctgaaagcaactccttcttttctgttgtaaaatttacatcttccgtcagctgcatagcactctctcctttaatcatatcagtaatctattcacttatatattatctgcttttttcctatatttcaagtcttttctgtattttccgccgtacaaacaacagcttccgcactctgcagactttcccagtgttcaagaaaaatccgggcagatgcttccctttcaggaaacagctgcccggaataccatattctccttgggaaaaacctttccctctacgcactcgtatttgttttttccagccttctgcggctgatctttatgtaatcctcctgcatctccaggccgataaattttcttcccagcttcctggcggctacgccggtcgttccggaaccgcagaaaggatccaacaccagcatcccatcttcggttgaagcgcggattatccgttccagaagatattccggcttctgtgtagggtgcttcccctctttcttttccgaagccctggtcaggcttcccgtccacacatccttcatctgtttcccgccgttttcctccttcatcaaatcataattgaaatgatggtgcgccttcttattatcctttcgtgcccagagaatcgtctctgtggaatgggtgaagcagcggcaggccaggttaggcggcgggttggttttctgccaggttatgttattgataattttatagccttcctgctccagggccaggccgatggaataaatattatgaagcgtaccggaaatccatatggagccgtcaggcttcagaacctttttacacaggcgcagccatttccggttaaaggcgtgcttggaattgcagtccattccctgatcccaatcccctttatttacggaaaccattttaccgccctggcaggtcaccccgtcattactgagaaaataggggggatccgcaaagatcatatccacgctctccggttccattttcggcagaagcacaaagctgtctcccagatatagctgttccgtttccgtttcataataaggcttctgcctggtatgcagtattttatccatatctttttccggcagccgctcatactcccgcggcaccctgcgacagcccctcctaatagtttgttatgataatttcctcccccaccctcttgctggcatcggagttgatattacgctttaccaccaccacttcctttcggaagccctcatatagttcattgataaaatccgtattgtggttggtcagcatacagctgcagcctctttccgtaagctcccggaacagtcctgccagcctctgatggctctccacatcgaatccctccttggtataggactcaaaggaggaaggattcaaaggagcataggggctgtcaaagaacacaaaatctcccctggccgcatccctgcaggcatcctggaaatcaccctccattatggtcaccttctgcagatattccgatacagccagtatattttccggactgcaggagcgggccctgctgttattatagggcacattgaaataccctttttcattcacacggtaaagtccgttgaagcaatgtttattcaaatataaaaataaggccgccagctccccgtcgaattctttctttttcatcttatcgttgaaaatttcccgtcgggcataataacaggccttgccatccgcagccgcctcttcatccagcctgtctgtcagggcaatcacggcacccggactcgttttaatctgtctgtacaggttaacgagggcaggattaatatcattgatgacagcacacgcagggcaaagggcgaaaactaccgcccctccccctacgaaaggttcataataggtgttatatgtttccggcagctttgcgctgatctgaggcagcagctgccttttaccgcccgcccatttaataaagggcgcgatgggtgtgctattcatgctgtattccttcgtttctgctgatactccatcggcttactgaggagtatttgactggtacgcatggtttccctggctggggtgtgccgccgtatggccctttcctgcagccgctgtcgggcagtcagtgtttcctgtaaggggcgtctaaaaacgccagtccttacgctgtgtcctttacagcgttagtactgctgcgtttttaaccgagcgagagcgtcccctgtaaggaacactgactgcccgacagcggctgcaggaaagggccatacggcggcacaccccagccagggaaataacctgcgcgctgtgcggcgcctttttattatagaagaaagcggaagaaataacaacccaaatcacaggacggaattcagataatatcaaatctccgccggtcctgccgctgtctggagcttcttcatacagtaaaaatagctgaatgccagcagcaaatccgctccgagccaggcgcatacctctccgtaaaaaacgcccgattcccctatcagcgccggcagaagcagggcacagccggtacgcatcaccagctggacaatgctggaaatcatgggcagaagggaatttcccatcccctgtatgcaggagcgcgtgacgtagagtatatacagaaacgggaaaaagacagccagtaccaataggaaataatagcctatcctcatggcgccttccaccgtcacgctgtctccggtaagaaaacagcccaaaacaggctttcccaaaaataccatgatcgccgacatcaaaagcgcggtagccgctccgatcaggttggcagcccgcagtcctttcccaatcctgtcatacctggccgcacccatattctgcccggaataggttgacatggcatagccgtaagaagaagctgcaatttccagaagcccgtaaagcttgttcgccgccgtgtaaccggcaataaacaggacaccgaaaccgtttattacggactgtacaatcaggccgcccatggccgtaatcatattctgaaggcccatgggaagccccagcttcagctgttcccttatcacgtccctgtccggataatattccttatttcccagggaaaacagtccgcttccccgcagcttcacgcagcaaaaacaagctgccaggatctgtgccagcacggtagctgcagcagctccctgtattccccagccaaagccgaatacgaacagaagatccagcgcgatattacaaaaagaagaaagcgtcattgcctggagcggcgttttgctgttccccaaagcccgcagcagtgcggcgagcagattataagcaaaagcaaccggcaggctggcatatagaatccgaaggtaaatgagagtcaggtctataatttccgttggcgtacgaagcagcagcaaaacgggccggagcataagctgcccaagcgctgtaaacaaaaccgccgcgcccaggctgagccagaccgctcctgccactgctttttttaatcccttatcatccccggccccaaattgtctggccatcaccagggaaaagccctggacaagcccctgaaccagtccgaacatcagaaaggtcagccattccgcggctcccagagccgccagggctttcactcccagggcctgccccaccaccatagtatctacaaaggtataaaactgctgaaacacattccccaacatcaaaggaagggcgaagcgcagaatcagccctgccggagaaccgttagtcatgtcttttgtctgcatacaggctcccttttctcaggaatggaattcaaaccattccacttcaattcccggcattttggtaggcgtaaggcataattcatagtatcctttttccaatgtcacatttcccatatcccgttccacggacgcgccgttcgtcccgttaagctggggagtcataaaacgcacaccgttcaggctggcattgcaggcggactgggcgcggaaatccggattatccgttttcatacatatccttacctggtatacaccggcattttccacaaaaataaggacgggcgtattcataggtgtggaaaccctgcaggagctttccaggacagccgccttttctttgcatccctttacctcttccgcttcttttgcgggaatcagctccggttcctcttccggcaggagggaacgctccatgacaggcgctttcatcaggaaacggcagatattggccgcacagcgttgcagttcgcccagagtcagctttcctgttcttaaagcctccagtgtattatcccccatgggattattttccgccgccagattatccactaccatatataaatcattctgggcccgcaccatggccgccgtattttcccggctttcctccccgccttccacacaatcattcatggtagaccaccagtcggtcataacgataccggtaaagccccattccttccggagaatggtcgtattcaaatcataattggaagcgctccagtggccgttaaccggattataggctgtcataacggaattggccccgccttcctttaccgcaatttcaaaggccttcagatagatttccctgagagcccgctccgaaacaaccgcatccaccttatttctcaccttttcctggctgttgcaggcataatgcttcatggtggcgttggagccgcccttcataataccccggatattagccgccgccattttaccggtcagcagtggatcttcggaaaaatattcaaaattccttccgttgagaggatttctgtggatattaatgccgggccccagaagggtgtctatctcattgcgaagaagttcttttccttccatgacataaagctcttccacaagaggtgtatcgaaagtacaggccagcagggttccgatgggtacctgggtagcctgtgcccccacatccatgcggatgccggagggaccgtccgcagcggccgccacaggaattccatagtcatcatgcagggatttgctcaatccgccgaagcaggaagccacaccgggcgttacccgcggactgcacatgccttctccgcgtacaatcgttgccagttcttccggcgtcagctgcgccaggaaggcttccattggctcattcccttccagcacatccctcagctggatctcacggtttcccgttcttgtaagcgcgggcggcatattgtcgcgaatgcgttcctccagggatacggtccttaacggaacgttttccccgctcatctcataaatgccgccggccttacatgcaccgggctttaaccggacaaattccttctgaggtgcacaggcttcctccagccgttccgtcacgatcagcctctccacctgaaaaccttcctcgccgtccacctgtacctgctccagatcacggatgctcgtcccggcataaatccggtaacagccttcttccagcacatagcaggatttatttccggtatatcctccgtcatcataggctgccatagcattcacggggaactgcaggaacagctcttcctcttctcccggagccagaaggcccgtcttggcaaacgccgcaagctcttttaccgggcgtcccagttttccctggggggcgctgtaatacacctgcactgcttccctgccggcataacgggaacccgtattttttacagttacctttaaccggatttcgccgtcctgcaccctggcgccggaagcctttacgtcaaatgaggtataggacaggccaaagccgaagggatacattaccttttccggggcaaaagtttcaaaatagcggtagcctacgtaaatatcttcctgatatatgttttccagttcgcctccatggttggcagtggagggataatccgccaggctgtatgcgatggtatccgccagcttcccgccgggcgttacctttccggtaatcacatccgcagccgcattgccgccctcctggccgccatgccatacatacagtacggcggttatggggtttttataggtttccgtcaaaaaactcatgtcaatgacacaggtcacattgaggattacggctgttttcttaaaatatccggttaccatgcggagcaattctttttcctggctgttcagacgatagctgtcctccaggtcctcatagtccttaccttctcccgccgtccttccgatgaccaccagcgccttatccgattttgaagccgcctgtcttaccatttcctccgtcaccggcatttccttctggttccagggttccgccgcccatcctcctccgccgtcgtcaaaaggattctcctgcagccagctttcataagctcctgccagttcttcgtttactttgacattttcgcactgcctgaggctgtccagcagatttgtggtgtaaggtacgtttaccgcccctcctgaacctgtcccgcttctgtaataatccttctggatccttccgaacacggaaacgcattctccgtcctccaccggtaaggtattctcctcatttcttaataaaactgcaccctgagccgccgcttccctgcacagctgcgcaaatccctcaagtgggacaccaatcatttttttactcattgcatctctacccgcctttttattttgcattatgtacccttagtatatcataggtttataaggattgaatacgggaaaatgtgaggaatgataaagtaaaaaagggaggcatccataatggatgcctcccctttttgattccgtatatattattccccgtcaggatttattcctctccctttatcgaagcaataatcccgtccgccagtgtttccagttcggaaaccttatccggatgcaatgtggacgccatggaaagccgttcattcagaacggtcatgttcttcatttctccctcaatgaatttctgcatcagatctccggacttgcaggcccaggaaccattttctatgagagcaaaagtgcggttctgcaggttcagcgccttcatatctgataaaaagctgtgcattaccggataaatgcccagattataggtaacggaggccagcacgatatggctcaggcggaaggcttcggaaatcagctgggacacatgggtgttggaaacatcataaaccacaacattggtcattcccttatcacagagtctggcggccagcgcctgtgcggccgcttccgtattgccgtacatggaagcataggcgatcataacccctttttcttccggctcataacggctccagagatcgtatttttcaataaaatagccgatgctggaacgccatacgggtccgtggagagggcagatcattttaatgtccagcttggaggcttttttcagaagggcctgtacgggagcgccgtattttcccacgatattggtgaaataacgtctggcatcgtcaatccagtctctttcaaaatccacttcgtcattaaacagcttgccgtccagggcgccgaaggaaccgaaggcatcagctgagaacaggacaccgtcagtcacgtcgaaagtcaccatggcctcaggccagtgcaccatgggagcattcacaaaggtaacggtatggcggccaaagcattgggtatccccttcattcacttccagctgcgtatagttatcaatgtcaaaaccgaactggcgcatgagcataaaggccttgggggtgctgataatggtaaccttggggaaacgaagcaggatttcttctatggaagcgccgtgatccggctccatgtggttaattaccagatagtccagctgccttccctgcaacagataatccatgttttccagaagctgtctgcatgcggaccagtccacggtatcaaaaaggaccgtcttttcatcaagcagcagatacgcattataagaaacacctctgggaatgggatgaatattttcaaacagggtaagcctgtggtcattggcacccacccagtataaatcttccgttacatttctgacacaatacatttctatttcctccttccggcctcagcctacataaacatatctttactttccgcacattccggacaaacccagtcttccggcagcttttcaaataaggtccccggagcgatatccgcgtccgcatccccgacagcaggattgtattcataaccacagcctccgcaggtataaatctttccgatttgagccggcttgggaggcagcggtcgtttcattttcaccatgggcggcgcaggcttcttggcttccccgttatccagggcggccgtgagcagcggcaggatttccatcacatctcccacaatgccgtaatcacagtttttaaaaataggggcattggcatttttattaatcgccacgatcgtggaagcgtcccggattcccttcagatgctgcacggctccggaaattccgcaggcgatatacaggttccctgtgaatttctgtccggacattcccacataccggttcaaaggcacatatttcagagtctccgcaaccggccttgaagaacctacagccgcgcctgcctgtacagccagggcttcaatcagcttcatattttcccggctgccgatgccttttcctgccgagacaactctctcagcctgggatataggagtatccagcggtattccgacgctgaaatcatatccttccttttgcagggcggcgacaagcgcttccacccgttctttggcgctgccttccttcaaaatctgtttcttgcggtagcctgttacaggagccgcttttttcgtgattttggcaggaccgcctgcatccttcggcatctttccgatgagatgggaagcgatgaccactctctggatttcattggttccttcataaatggtagtgattttggcatccctgtatgcccgttccacttccatgcctttcagatagccgcttccgccgaaaatctggagggcatcgtttgtgacctcaagggcaatatcggaagcatactgcttggccatggccgcctccataccataaggctcatggttttccttcagctccgcggcactgtatatcagcagccgggcgcagcgcagcttggttgccatatcggcaagcttaaaggaaaccgcctgctgctggcatatgggctttccgaactggacacgttctttggaatattccaatgcatgctcaaatgctccctgggcgattcccagcgcctgggaggcaatgccgatacgtccgccgtccagagttgccatagcgattttaaagccttccccttcttttcccagaaggttctctttgggaactttgacatcattgaatatcagttccgcagtagaggaggaccggatacccattttatcataatgatcaccaaattcaaagccttcccagcctttttccacaataaatgcagaaattcctctggtgccgatatccggcgttgtcaccgcaaatacaacataggtatccgccttcggcgcattcgttatgaatattttgccaccattgagaagataataatcacctttcagtaccgcagttgtttccgtgcctcccgcatccgatcctgcgttgggttccgtgagaccgaaagcgccgattttttctccttttgccaggggaatcagatatttctttttctgtgcttcattcccgaaggcaaaaataggccaggagcctaacgatacatgggcggaaagaataacgccggtaccgccgtccactctggatagctcctccaccgcgatggcatagctgaggacatcaagccctgccccgccgtactccttcggatagggaatccccataagtcccatttctcccagcttttttaccgcttccgccggaaattcattgttctgatccagcataaaagcgattggtttcacttcgctttctgcaaatcccctcattttctgtctgaatgcttcatgctcctgtgttgtttgataaagcatatttgttaccccctttttataaaatggattataagtgactctatacatttactgcctgctgtgcggcagatatatgtctgattgtctgtgattcctgctgttttttccctttttcgaggcagtaatacttgacaaattttatccacttttgcatcttaaaaaaatcaatccccaaacaatacccaataaaggctccgggaacggaattcccggtctattgccagctgcaccttggccagctgtccgtgcacgttacagggacttccgtttttgtccctccattcgcactggtaatccgcagtcatacaggccgccagacgggcgttggcttccaccgcattcaccaaatcatacaggctgactccatgcagatccgcgtccagctgacagccgccgttcactccgcggataatacggataatcccggctttttccagctttttcatgatcttatatgtgaacttatggggcagcgattctttctccgctatctcccccaccgtcaggcaggagcccggggccaaagcccttaaaatacggagcgcataatcggtttcacgagtgatgagcaatggcgcgcctcctttttctttgtctctttctttaactataataaagtggagtaaaattgtcaagattaatctctataatattgcgcctgcatcatatataattctttataataatgatttgattccatcagctccttatgggttcctatttcaaggatcgagccgccggaaaacaaggcgactttatcacagaatctggtactggaaaggcggtgtgaaataaatatgacggttctgtcatttgtgacataattaaaatgagaatacagctcatattccgcccttggatccatggacgccgtaggctcatctaaaataaacaggctgccgtccttataaattgcccgcgccaacgcgattttctgcacttccccgccggagggttcatatccgttgtcatcaaaatccctgtgtatgatggtatcctccgcgttggagagtcctgctattttcccctttattcccgctttttccgccgcatcttcaaaacggggcccgttttccttaagggggccggaaaaggctatattttcataaacggacatggaaaacaattggctgtcctgaaatacaacggaaaacctgctgacatacttttcataatcatactccttgatattgatgccattgacgagtatttcaccttgcttcacatcatatagccttgccagcagcttgataaacgtagacttcccggaaccattttcgcccactattgaccatttttcacgggcatttattttaatgcttatatttttcagcgcatattccttttgctccggataccgaaaccatacatttttaaattcaatggtttcaatatcgtcaagaggtttttttccggtccgcatacttgacggcatattcagatacttcttaacggcttcgtagtaatcgttataacggaatatactggtaatgctcccggccgccatgaacattgccgagttgaaggagttggcagcgctccaatacatcataaaatcgccggccattatagcctttgcggcatattggaaagccagtgccgccaaaatgagcacggtctgcagcgtattaaagaagctatttgtgtattccgcttttgcccttgtcttgactatttttttatagctctttaaaatatcctgaagcacaagggtatatttaccgctcagccactctacgagattattgacccggatctcttttccgtagcggtattcgctgaaaaggcttccgtaatacatattttttctttccaaaggcgccttttcaatatcaaactggttcgctcgcttacgggttttggacgaaaaataggcgttcaataaagcaacagctataaagcctgcgatcagaaggatatttaattgtgaaacgataacgataatacttacgaataggattacattgccaatcagggaaaacatttgctccaaagcgctagcaaagtcggcctccccatacaaaaatttaaatgccttctccttaatatccaaaaaggagctgctttcaatctgcccataatcggcaaacgccagctgacgtgaaagttggatttgaaaatcattaaaaatgccgagcttccgcacaaaaatgttagcgtcgcaataattgtcaaataagcgaaccacaagatagatgccgcaaagtataaggatatatgtaagcgcggtatcgggaggcatggcttcggtcagcagatccaggatatatttgggtataaatatcaacaataaaggcaatgcgcttgaggttaactgctttacaatcagcagaaggatatatatcttatcatggctccagcaaaagccgaataaaaatgacatgccagccataatgctcctggtaaatttcaacttggatctgcccaatttgctacctccccaatccgaatttgagactaaaaggttttcagtaagagaatagcctttccatatggttttataatatctttaagtctgcatgttaaagaaaaataaagccaccggaaaagctatcccttatatgagtttaccatatttttctgttgctggccatacgtttataattgatttaattaacgattttcttcctgacaacgggaatggaaataatttggcttattagctggctattttcaacaggatcctttaaaataactgaatacagataactcttttatgcgatatattccggaagggaggaagaatgaaagattatattcaacagaataaggaatcctgggagttcaatgtctacgatttctgggtaaaaaatgcggggactccggaggagcgtgccgccaaagacattgaggctcccattaaaatgctgaaaaagtatgcagcatattttgattcctatgaaggtgtccgagtcgccaacatctgcggttcctgcggcaaaaaagcgattccgctcgctcttctcggcgcaaaggttaccgtcttcgatatttcctcggaaaaccggcagtatgccatggaaacagcggcagccgcacatacttccatcgattttgttgtgggagatgtactggaaatcgacatggaccggtacggcggccaatttgacgtggtattcatggaaggcggaatccttcactatttccatgatatccgtgaatttatggatgtcatgtattccctgctccgtcccggcggacgcatgatatgcagcgatttccatccctttcagaaaatagcggatattctggaattccagcagcctgtgacttcctacttttccacagatatcataaaaggggaaatggctcacgccagattctatccggatgaaatccgccggcaaatcccattatgtgaataccggaaatataccatcagtgaaatcatcaatgctgtcatagagagcggctttaccttaaagcgcttcgatgaacattctgcctggacgaatcccggcctgccgggtgaatttaccgtaattgccataaaagaataagccagtacggcccggagctgtcccggcatcattcggaggataaaccttatgcgttcagaaaaagaaatgatggatattatcatgaacaaagccctttcggatgaacggatccgggccgtaaccatggagggctccagggcgaatcccaatgccgtgcatgacagctactcagattttgacatcagttattatgtgacggacatacgggagtttacgaaggacaaatcctggataaatgagctgggcgatattctgattgcccagttccccacggattggtactcccacccatatgattacggaagccgtgctccctttgccttcctgatccagtttgctgacggcagccgcatcgatctgactttggtagacgtgaccaatatttcacaggaagctgaaaataaagaaccgcggattgtgctgctgaataaggataactttccatacctgctgccgcttcaggcggaagacgtcttcttcctccggcctccggaagaaaaggaattcctggatacctgcaacgaattccgctggctgagcctgtatatttccaaaggcgtatgccgggaagagctgtactacgccaagaatgcctacgacgtactgatcatgcccatgtttcttaaaatgctgaactggagaataggaacagagcatggcttccgggttaccaccggttcctcatgcaaatatctgaagcggtttctgagcacggaagaaatggaaagattccagggcatctttcccgacggcagctatgaaaatatctgccgctgcctgtttctcatgtatgattatttccacgaatcagccggccgtgttgccggacattttcacttttattatgacaggatggaaatccagagagtacgacagtttcttgaggacagattccatgagaagggatttttcatctgaaggaggtaaatatgcgtattactaacggttccgatccggtatttgacaagctggtcaccggaaaagacaaatatctttttaatctgctgtatcggatccgggaggatcccggttccttcctggccacagacgacagtacctgcatcatcgcccggagcaatccgaatacgccggtctggatctggctgaagcatccgccggttcctccggtccgtcaggaaatcgccgcttatctgagccaatgccttgccgggagcggctgcgtgaatatttcttcctgccctgcttattccgaagatctgctgagagaagctgccgcgcagaatcatggggaatacctggtgaataagcttctgaattcctatgcctgcctgtccgtcaggccagttaaaacccgcgggcggatcaggtacccggatccctctctgaaagaagccatggcccggcttatcaccgtgatgtatctggatgcaggcctgggtgaattaagccgggaggaagcccttgacttcgcagaggaaaaatcctcgtccgacagactgtttctatgggaaaatgaacagggcgaaatagtatccatggtcaatatcgctcactgtacgccggagtacgcccggttaaacgcggtagtaaccgatcgcagtcaccgcggcaaaggctatggcgccatgctggtatccgaagtctcccaaaggctgctgcaggcagggcagatccccgtcctttatgccgatgccggctacccgccttccaatgccctttatcggaaaatcggttataccgaacagggacaggtggcggaacagcgcattatccgtaggtaaaccaacggtagaattgcccattctccatataatcggtatcttttcggcgatttctattatattcttaatgtatcaactacgacagaaagggctccagaatgaataacgaaaaaatggggaattttatttccgaaatgagaaagtcccaaaatctgacacaaaaagaactggcggcaaaactggaaataacagataaggcaatctccaaatgggaacggggagtttcccaaagttaaagataccacaccattcccacgctgacttttgctcaaccgatacagccggagggctggataacaagaaaaggcggtatgcgccccgtggaggggtagcgtaccgccttttcttgtgggggtttccaaagggggcaacgcccccatttggcacacgactttgcgaagcaaagtgtagtgtgttatacgctctgacggcgttgccatgaaaatgccgttgccaccggggagggcaagggcatttgaagcggcaggaaaacagggctgtgcttgtgtggcgtggagccgcaagcgcagggctgttttcatcagcagacagggcgtatatgaaagcccccgtccctcgtcctacgctccgacttgtggacaaagtgtcccgaagttgtggccacactcccgggaaagtagcgggacagcggggaaccgtcaaggctgaaatgaatgggtttacacccggccttgaccgccgcccgccgtcccgctgaatgggtgaacaaggcggccaatccctcaaagtgcttggccgatctctttttgattttggagcgtttcttctctcaaatttgaaatgggcgggaagccattttagggctttcccgccttgattgcccatcagcaaagacagacgggactgtcaacggcggcgcataaaatgcgccgttcatcttgaccgttgactggctcggctggctttgctatctttatagacttaaaaaggttaataacatataacatctctttctacttctgtaattatctctttcgatatagtgtttacgttaagtaaataaacttcatttaaacgaggattaaatattcctaaattttggatgctcttatatattttttgaccagaatgttgccccattatccagtacatcaatagttgtagtgtatgtttattagtcggttttgatttactcactttaaaatcccacaaagtatcggctgtaagataatcaccatctcccgaattaactgtttccgtatatccattaggctcaaatgtaaaaccgtcttttacaatagggccgtagtcttcccaaaattttacacttcgttgaaccattatttttatgttttgtatagtttctgcgtctggattgatgtcatctgcgcccttagccattattgctcccatcggatttctaaaccatacatcatatgttactaatttgcaggcgtttgtaattgacttctcatcaatagcttttattccagctaacaatttacttgcttttttcatggcatttttttgtttaaacaattcttctgccatttttgcgcccatacaggatattttaaacgcttccaaaagttctgaccccattgcaaatcttgttaaatagtccacagccattccaacaacagaagcatggatattctcggtttcagataaaatatgaccatcatcaattttatgtatctcaaattgagatggctttacatatcctcccctcggttgttttatttcgctaattctttttgtaactgaactcatttgcaaacgctcctcctttggataatcttatattttattcaaataaatacccgcccatttcaatgtcaatattgaccactatttcatctggtgcatcagacacaatgtatcctcttacagcaactatatctttcccatctttatcatatatagttggcattatgtcttgatgtattttcgcttgtgtaagaaaccttaataaatgatttttgtccgtgttgtgccccattaaaaccacttttttgtttgatgctttatctctcaatcttgcacacaatttaccattttgattgctatattcttcaatataacaagatattttaactaattctttcattgaatttctcctaaatttatcataacacaagactttttctcctgaacagttcatgtttatcctgtctgctcaatcatcctcttcgccaactgctggaacaggtcggcagtttcttcatccatcggcgtaagctgtccgatctgtccagctatcatcgccgttacatcgtcaatggaaagcggtttttgtttctgttccgccagtgcgtcccgcatggcttggaacatagcggcggtcacagcttctcccggctgttccccgttgtcaatgtctttcttaatgtcccgcaggatagccaggaacacatttttgattttttcaatctccgcttcatgttcccccatcttttgggcgttcaaaagctgtaaatcctgcttcgcttctgcccggtgttccgggtgttctttcatcaggtcggacagggaagccgttgccatctcgataagctggtttcttgctgttatgccctttgccgccgtatcctgaaaataaatccgtatcaaatctatcagcttaggaaaattcctgtgttccaacaggcggttgaggatttgcacatcaacagcacccgtcacaagccccctcacggctccctcggacaagcctaattcagaaatatcgtagcttttacgaacgctcacggtagacaagcccagtatgtagtctgtcgataccttaaattcctttgccacgcctatgagaatatcactgctgaccgttcttgtttcgccgctgacaatgcggctcaactgggaagcggaaacgcctatcttctccgcaagttccttttgtgtgatgtggttcccgttgcataaatcggaaatccgctgtccgggtgttccgggtaaagccatagatacgcacctcctccgcatacttccattatacagaatgattgcaaaaatgcaatttccaaagtgtaaacttcatcaaaatgcaattctcgcaatattccgggaattgcatttttttcgtgtagacttagggtagttcatcgatggacggcaccttgaaaacagaatgaccgtccgaaaaggaataccccggctggggaagcaccgcaaggagtcggacttcgggacaaaatgtcccgaagttgcgaggagcgtgccaacgccggaacacgccgcaggaatggggcaggaaaccttttcggggagaacggcaacggaaagcaaaatggagggaacgcatgagagataacccctataaagacttgccgccgctggaacgcaggccggacggttccctttaccgcatgaccccggcgcagagaaaacaggcggccagcctgatacgccgggagtgctgttgctgtgaggacggcaactgcattgtccttgacgatggggacacctgcacctgtccgcagacgatttctttctcggtctgctgtaagtggttccgctgggcggtcttgccgctggacgggacgctggaagcggagattttccgggataaggacttgaaacgctgtgaggtctgcggcggtgtgttcgtccccaaatccaaccgggcaaaatactgccccggctgtgccgccagagttcacaggcggcagaaaacagaaagtgaacggaaaaggaggtctgctgtggacagttaggagcgaaaaaagccttgatttatcaggcttcgcaagccccaaaccggggctggtggtataaagtatcgcccgccccggaaaacgggcttctaaccgtccacaaaacacactatgacaaataccatctatatccatcagccggaaaaggcgttcagcttcacccggctcccgaatttcctctttgaagcccccacattcaagcccttgtccaacgaggcaaaggttctgtacgcctttatcctgcgccggacagagttatcccgcaagaatgggtgggcggatgattgcggacggatttatctgtactatcccatctgcgaggtggttgacctgctccactgtgggcggcagaaagcggtaaacaccctgcgggaactgcaatacgccgggctggtggagatccagaagcagggctgtggaaaacccaaccgcattttcccaaaatcctatgaagcggttccaaacaccgacttcaagaaatccggttctggtacgccggagggctgaaaaccgtactctatgaagtgcggaaatcactccccggaagtacgaaaaccggacggtatatagaaatacaaagattaaaaagattgatttatattctatccattccaatcctatccgagctaatttctgcgggattttccctgtggaaaaccccggataggaaaggaatggggaaaggagcagaatggcacaacacgcaattttgcggtttgagaagcacaagggcaacccggcaaggccgctggaagcccatcacgaaaggcagaaagaacaatacgccagcaaccccgacattgacacaagccggagcaagtacaactttcatatcgtcaagccagaggacaggtactatcatttcattcaaaaccgcattgaacaggccgggtgccgaacccgcaaggacagcacacggtttgtcgatacgctggtaactgccagcccggagtttttcaaggggaaatccccaaaggagatacaggcgtttttccagagggcggcggacttcctcattggccgggtaggacgggaaaatatcgtgtcggcggtggtacacatggacgagaaaacgccccacctgcatttgacctttgttccgctgacaaaggacaaccgcctgtgtgcaaaggagattatcggcaaccgggcaaacctgacgaagtggcaggacgattttcacgcctatatggtggagaaatatcctgacttggagcgtggggagagcgccagcaggacaggccggaagcatatccccacccggcttttcaaacaggcggtttccctctcccggcaggcaagagccattgaagccacactggacggcattaacccgctgaacgccggaaagaaaaaagaggaagccctctccatgctgaaaaagtggttcccgcagatggagaatttctccgggcagttgaaaaagtacaaggtcacaatcaatgacctgctggcggagaatgagaagttggaagcaagggcaaaggccagcgaaaaaggaaagatgaaagatacgatggaacgggcaaagctgaaaagcgaactggacaatttacagtggctggttgaccgtatcccgccggatatactggcggaactgaaacgtcagcagcggcacacggtaaaggaaaggtgatagatataagcagaaattttcgccgcctctgtgtggcattgtaccttgaaaactgaatatggaggacactggatggcaaaaagtgaaagcgatatttttacaccccgaacagggcaggttatacaagcagagaacggcacgcagtattttgtatgtgggaacaaccgtataaaaatctccgaacacttcgccgcaggcgggaagcccctcggtgatctgattgtagatgtggtgcggcataccgcagaaaaagccgcttcaacctgatagcccatcattgataacacgcccacgcttatgatataattgccatagagcaaaagtattgtaagcgtgggttgtttctttagaaggaggatttttacggtgaaacaaccttacaatactacgatttacaacacggcgctttatatgagattgagccgggacgatgaactgcaaggagaaagcgggagtattcagacacaacgcatgatgctccggcaatatgccgccgagcatggcctgaatgtcatagatgaatatatcgacgatggatggtctggaacgaactttgacaggccggattttcagagaatgattgatgacattgaggacgggaaaatcaactgcgttgttacgaaggatttatcccgcttaggcagaaactacattctgaccggccagtacacggaaatctactttcccagcaaaggcgtccgctatatcgctgtcaatgacaatgtggacaccatcaacggagagaatgagcttgccccattcctcaacattctgaatgaaatgcacgcccgccagaccagcaaaaaggtaaaggcggccatgcggacacggttcgcaaatggcgcacactatggagcctatgctccgcttggctatgtcaaagacccagataagaaaggccatcttctgattgacccggaaacaaggtggattatcgaaaagatttttgaccttgccgttcatggccggggagccgccagcattacacggattttggtcgaagaaaaagtacctactcccggctggctgaatttccagagatacggcactttcgcaaatatctatgccggagcgccggagggaaaagcctatgcgtggacgatagcgcaggtgaaaagtattctgaaagaggaaacctatatcggacacagcgtccacaataagcagaccaacatttcattcaaaaacaagaagaaagtacgcaagccaaaagaggaatggtatcgtgtggagaacacccacgaagcgattatttccgaagatgtgttccgtcaagtacaggagcagatttgcaacaggcgcagacggcagaagaacggcacaacacagatattttccgggctggtaaaatgtgcggactgcggctggtcgctggcctatggtatgaacagccagaacaaaaatccctatgcccactaccattgtagcaagtacgggcaaggattgcaccagtgttccatgcactatatccgctatgatgtgctttacgcctatgtcctttcccgtctgcaatactggtctgtgctggcacagcaggatggggacaaacttctgaaacggctacttaacgccagcgacaaggaacgcaatactgcaaggaagcggcagacagccgaactgaaaaaggcggaaaagcgcaaagcagaagtagacaccctgtttgcaaaaatgtatgaggactggtctgccggacgcattacagaatacaatttcaatatgctgtccgaaaagtatcagggcgaacagcgagaattggacgcaaaaattgaacggcttcacgaagcgatggaggccgccgcccagacagcggttgacgctgaaaagtggataggtctgatgaaacagtatgtcaatcccacagaattgacggctgaacttctgaatacgctgattgaaaaaatccttgtccatgaagcggtcaaaagtgaggacggaagccgggaacaggaagtggaaatcttctaccgctttatcggcaaaatcgaatgacacatcttgagatacccaacaatatctttaactaagggaaacgggaatcagctgtcctgatatttctcttctgatccctcttgcccagatattaggtgtgacaacaagcgaactgctgaatggggagaaatgcgccgcccccgaaaaatcaaaagatgttttagtggaagaaaccctgctgtattctgaccgaagcgccgcacaaaaggttgaccgggttaaaggaattctattcacctgtttttcttcctctgtcatcctcgccgcggttatatgctttatctgtgatttctgcataaccggacagctgacatggtcactcctgactgcctcatccctgctgtttagctggattcttttgctgccgctgtttaaggcccgtaagaatatcatccggaaatcacttcttgtgctgaccctgaccgtaattccttacctggcagtattaagcaggcttttatctttgcctgccatttataagatgggggctgttatagcaattatttccctgcttggactgtggtgtatttatatccctttcctgaaaattccccatcgaaaattatatgtaaccggaattttacttctggttatcataccgatcatgtggggaattaatggtacggtttctttttttattcagcagcccctggatccttccacaaaattcgttgatagtctgaccactctggttcttctgattatagctgcattctgcttcagtaaggaattctttcggaaccggaagcagtaaattggcccttgtaaataaaccgttcttcctcagaaacgcagaagtcctccgctttgcagcgaaggactctcttttaaggttccatcaaatatacatcatcaaagaatttcatatttcttacttataaaattctctcacagcttttcccagatattccgccattccggcgccgtactgctcatccatgctctcgctcatggccggattattttcatacgaatccgcaatctccagcatcagctgcttcacatcctccatctggtacagctgttttgatacaaaatccagctcgcctatgagggacttcacctcgaaagaagaaacatccacaccgcgcttttccgccagctttttataaattccgtcaatccggttccggtaagcctccatgacctccgttcccgcaggattctttaccgcttccatggctttatccttatttccgtaccactccaccaccttgcggaaattcttctgggcgtcctgtccggatgcattttccagaaaatgttcccggaacttctccagacttccgtatttctccttcatcacctgaagctgttcctctttcatatttccaactacagcctgatacatctcatctatctctgttttactgaacatctcaaaatccattttattttctcctttcaaaatgtctgtaatcccggcgatcatgcggttcaaacgatcccgtttgatctccagcatttttttctgggttaacagtacggaatctctgtccagttcaggattatccataatttctttgatttccaataacggcatatcaaattctctgaaaaacagtatctgctgcaaacgttccagggccttatcgtcataaagcctgtatcccccttcactatatgaggtaggcttaagaagccctatttcatcataataatgaagcgtgcgtacgctgataccggtccgttcggatatttcttttactgttctcattatggtccctcctgttcctgacaaaaactacactacaccctcacgctccgtgagtgtcaatacattttcaggagattttattcattcttttctttccttgatccgctgcctcatatacttattaaagctttctgcctcctccgcatcaggtttcatttcccggtccgatgcatagcattccagcgcttcccgcaaaagcggcgcgaaagccgccggtacgtttgcaagtccccattcccctccggtttttttcgacagaataaggccttcctctgcatatcccagaacccggcataaattcagaattacatagagcggattctccagaatttcctctccggaggattctatatcactgcagatactcttcaggtaaaattcccgcggcacctcatcaaatacctcttccaccggtctgccatacaaaacaatgccataatgccggataatcatgaaatgggcagacagatccggatccgttcccttcatcttttttatataatcctccggatccgaccggtaccatgccaggtgggccggagaaaaatgcagttcaaagggcgtaggatattccctgctcctgcaggcctcctccgttaccatgctgaattctatccctttgcgcggccctgtctcatttaattccaccaggatatccatcagccgccttttctgcccgtcggataccgaattttttatcacaagtatcaaatcaatatcactcttatccggatgaaagcagcccatggctaatgagccatgcagataaatgcctgtcagctcctcaccgatgatatccttactcgtttcgacgattttgtctaacatgaattgatattccatctttattcctgttacgattccccttctttcagcgtctgcatctgaagctgcgccgtcaccagtttatagtatatccccttcttttccagaagttcattatgcgacccgcactcggcgatcttatgtccgtcaatgacgatgagccgatccgcatccttaagcgtggacagcctgtgggcgatagccagggtagtcctcccggccgtgagcctctgaagcgccttctggatcagatattcgctctccgtatccaggctggaggtggcctcatccagtatcagaagcttgggatcattcaatatggccctggcgatggcgattctctgccgttcaccgccggacagattatatcccttttctcccacataggtattatagccgttgggcgtcttgcagataaaatcgtgtgcattcgccattttggcagcccggatgatctcctcataagtggcatccggcttggcaaaacgcatgttattcaaaatcgtatcagaaaaaagaaaggtttcctggagcaccacgcccagctggcggtggaaatcctcaatccggtaatcattgatattgatgccgtcaatcaaaagctctccgtcatccacgtcatataaatgcatgaccagattgatcagcgtggatttaccggtgccggaagcgcccacaatgccgatcatctcgcccatcttgatctcaaaatttattttttccaggaccgtttcgtaggaacggtagccgaaggaaacatccttaaataccacatttccctgtatctgcctgcttaccggattttcccggttccgtatcttcggctgttcatccagcacatcgtagatacgttccaggctggttaacatctgcacgatcatcctgggcagatgggtcatccatcccagcgggccgtatagcatggtggcgtaggtggtaaactgaagcagctgccctacggaaagcccgccgtccagcgtcttcaggccgcccagagcggttacgaaataaatgcccatccccatgatgaaggtcagcatcgggtaaaaggaagcccagaatacctcattattcttctgaattctggcataatttgcagaaatcgtcttaaaacgatccgactcatatttctccttaccgaaggacttcaccacacggataccggagatcacatcctgcaacgcgctgttgttgtcatccccccggctgtactgcatgtggaacttacgatgaatgaccttgcggaaccccaccgacagagccacggccagaggcaggaagacgatggacaaaagcgtcagccccgggctgatggtcagcattacaatgattgcccccgtcatcagcacaatcaggtaaaagatactgccgaaggcatcctccataaatttacggatattcgccgaatcgttattgatacggttcatcagttcgccgggccgcctgtcctggataaaagacagcgtcagcacctgcatcttctgatagaggcggccgcgaatatccatgctgattcccgctccaagctttgcgctccagaggctgcgcagatatctggtgatgatggaaaacaccgtaatgacagccatgataagcgtaaagcgaatgacctcctgaaagctgccgtggtcggacatcagcgtattatcgatgaaccgctgctggaacatcgggcctgccaaacctaccagggaagaaaacagcatcatcagcgccaccatcacgaactgctttttataattcgtgcataaacggacaaattttaaaagagtgacatttttgccctcacatttgggacatacgcgggttccgggaagcgcgcggccgcatttggggcaggtcttttcatattccctgttctcaatgatccggtcgctgccttccagcatcagcatcccgccctttgcaatcgatgcgaagcgggagatatgcttcatggaaaagcgagctacatgccttgccagcccggattccttttccgtaaccacaagaatgccgttattgacctgtgattcgcacttcatcgcggataatccggaaagctgcatttcatatacgatccggccttcctctataataagcaggcgccggtttgtcagcaccccataggagaaatcacagtattttccgctgctgtttatgtcaaagggagagcaataacgtatctcctcccctccggcaagctcaaacagcgccctgatttccccgggcagttttacattcagttccatttaagtcctcattcctgcgccatgaaaagcgcgccaaaagctgtaactaataattatttataagaacaaaccgatttttttgagctcttttccagtaagcttcgaggtgtccggtatctcaaaccggttttcatccagatcggtgatcagaagtcttgtttcggtcagatggaccacagcgttgccgctcatatgtatggcaaaacggcaggggccatgatccgtcaccacgtcaaaataggcgaatccgtactcttccttcacattttttacctttgtgataatcggggtaaaataacgcagctccatctgctcagtcagcatcttccgcgtttcctcgtccacatccttatccagatcatggattacgccgatttctttcgccttctcgtccggctcccgtatggaaatatacatatttttacccgtaaaaggaaaggtccggaacacctgaacccggttataatgcttttcctgcgtatccagcgagacaaaaccgccttccgtcctgtgaaatgtactattgctcctgtccagatagttcagagccagcatggcctccgtctccgcctccatctgttccagatcaaactcttccgcaaacaaatcttccataactacctcatttctgtgtctcatacacatttattcctgccgatgtcatttctattccagtccccgcatggccagtgctttcgtctgcagctcccgcagcttgaaatatgtgcctttcctggccagcagctcctcgtggctgccttcctccgtaatccttccctcatccatcaccacaagccggtccgcatccctgagcgtggacagccggtgggcgatggaaatcgtggttcttcctttaataaggaagttgatggaagcctgaatcgccttttccgtctccgtatccacggaggccgtggcttcatccagaatcaggatccggggattggccagaatcgccctggcgatggaaattctctggcgctcaccgccggacaactccctgccggtagctccgatgatagtgtcataaccgtcaggcatcttgcagataaaatcatgggcgctggccagaactgccgcctgaaccacctcttctttggtggcatcgggattggcgtaggctatgttgctgtaaacgctgcccataaatatgtaggtttcctgggataccatagccacattgcgccgcagatcgttaaaagcgatgtcctttaccggtatcccatcgatgaagatctccccctcgtccggatcataaagccgcgaaatcatattgaccagcgtcgtctttcccgcgccggaacgccctacaatgcccagcatcctgccgccttccaccttcaggctgacatttttgagaatggtcttatttttatcataggagaaggttacattctttaactcaatgtctcccctcatgttatccatatgtaccggattctccttttccgtgatttccggaagggaatctataatttcaaacatacgctgggcgctggtcatgctttccgcccaccagtggaagctgaaggcaatgaaatccagcggattgttcagctgtcccacatagctgataaaggtgatcaaaatacccagctccagatcgccgtaccgaaagagcatgtagccgcccagggcccataccagcaggttggagagattttccaccgccgcatagagcacggtgaaatggttgtcaaaacgcaccaaatccacgtctgcatgcatcagcttcttattatatttatcgaaacgtaccagctccttctcttcctgtccgaaggcctttaccacccgcgcaccggtcaggttgtcatttaccctgctgttcagggaacgcctcgccctgtggcggctggaaaaatagttgaagagtgtcggagccattttgtagctggtaaacagcaccaccggtatccagataagcaccggcacggcgagcttccaattcatccggagcatgatcacagccgtggccaccagtgaaaaaatattggacgccataaagggcaggccgtctataaagaagccggtaacctcctccgaatcgcccatgaccctggtcatcaggctgccggtctgcttgctgttataaaagcccatggacagacggcccatggaatcaaacacgtctgttttcagcttcatcaccacaccaggtatgatcctggcatttaataccccctgaatgatgccgaacacctggatggtgagcttcgtcataaacatggaaagcaccaccagcagcaaagccgtcacatatttgcccgcaggaagatttaagaattccaggaactgcggatccttagccagcaccttatcgtagagaatcgttccgtttaaatagggccagaccagattcagcagcgccgtggtgataatacagatgaacatgcccgcaatgctggccgcatagggcctgaaatagcttaaggtgcggaaaaatacggagcttttgttcatgcaccggggacagatcttccgttccggatccggatacatcgtaccgcatttgctgcagtactcctcctctttttctcccttgagcagttcctccgtcagttccttgccctcctttacggcttcaaagactgcggcgaaatggcggagctgcgccaggtacatattggagcaaagcgccagccggatgtcgttttcctccccttccgggcggtaaaacaggatattggtagccacctgtttgagtacctgcagggatgcggtctccgccacagaaagcatctgaagctcataggttttgctccctgtaattttttccctttgatccatgcagcctttatactgcttcgtatacagaaaatctttgacggactgggcgagcataacctgcgtcttcgtcagcagcagccagccgtccacatatttttcttcaaagttcatgtcaaatcgggcagttatcagacagtcatcctctgtaatgccctgttcttccgccagggttttcagtgccagcgggagttttcggaatatttcttttgccaatgtcttgttcaggtacgggatcgaatgatgaatccgcgcgcctttcccctttctttctatactgaagcccggcaatacagccgaatctggtaactatgcagacctgccgtacagttaccggatttgaacaaaaaaaaccctcttccggctacggaaaagggtaaatgggttccatgtcaatacataagacaagtacgggcaggacaccatgccgattttttcgcaaacgggcgctgtaacagccggaatattgtgtgattgagaatatgctttctgctgtggaatatatttaaccgggtgatgatacctaacatgttgtctgcctcctttcctgaatgatttgtaaaagtgcggtttcatatgttaaattttataaaatatgcttcgaatcgaacaagttttataactatttattagtatagaactgtaggatgaatatgtcaaacagaatttatccgtcaggcgtatattgatataggaaaagcgtcatctgacgaccatccattaatgttacgtctatggaatccaactgttcaaacccctgagaatcataaaatccgtagttgcactgtgtatcagtatgaacataaattgcgcatttaccgttttgtgccgcataagacaggaaatctctgaccaaggttttcccaacacccgccccttgaatatttttccctacgatcaacaattcaatgtgtcctgtaaaatcccctttttgtacggccatcatcttctgatccgcttttgaaattttcaacacaccttttaattgccttctcattcgtttggttgaatgaagcagcagtgaaacactgctcttggccagtgcccatatcgcggtacttcgcctgacaatgttctgccggccgtcgtctttccccagcagaacgcccaccacatctccattctgtacggctgctttcccgtatgaaatattgagcaagctggattgcaggtaaatattcagagaatcatctaactgcttctcagtatcacaaaattgattcaaattccatacttcgtcaatcagttttttgattgaacgataatcattcgggcagatttcccgatatgttatttcttccatttcaatatcctccatattaatatccgtacctttttctatatcggaaaaagcatacaagcgaaactatgattcctaaaaactccgcgacgggcgttgtaagccagattccgtctatctgcaatacgcgtggcagcaacagaatcgctcccagcgagaataaaaaggtgcggcaaaatgcaatgacgccagatacaatgccattggaaagtgcggtaaacagtccgctggcataggtattaaatccattaaaaagcagagcaaacatgaaaataaaatttccgtgtactgctatttcatagaccgctgttcccgttcccgcaaaaattccaatcaattttccgccaaatatccatgcggtcaaagcagagatgccggacaccagcgctataaaaaccagatttactttcgtgagctttttcagcctgtccgtatcacgctgcccatagttatagctgatgataggagctgccccataaatatagccgatatacaaagccgtcatagcgctgaacacatagtaaatgaccgtataggcggcaacaccattttctccggcatagcgaagcagcgcctgattcatcaaaagcgcatttataccggaaacaagcgtggtggccatctcgctcattccatttgctgcggagtcaatcaaggttcgtatcctgaataccggctttacaaaatacaaaagccggctttttttgaaaaaataaataatacaaatgacggtggggatcagactgctgaacccggtggcaattgcagcgcctttgacgccccatccggctgctgccacaaaaagatagtcaagtccaacatttacaagtcccgccgaaagtgaaacaccaaatgccagcacaggattattcgccgcgacaacataaacttgcagattgctcataagcagagttggaattgcaaacaacgcataataaaacagatattccttacagtacagagtcacttgtggggaagctccaaacacagtggtaagcggttcagaaaagaggactccaatcacagtgaagaaaataccaaggaataaattcagaagaatgagcgcagtaaaatcttgttttgcctcactttctttttgctcccccagtttacgcatcacaatcgcgctccccccgctggagagcatggctgaaagcgcaaacagcaggctgaaatatggcgataacagtgttaaagccgccattgcgtccgttccgacaaatctggctacgaaaataccgtcaaccgtcgtgtacagcacctggattaatgccatgaccatcgtgggaaaggtgaacttcaacatatttcgatatgtaactggtttttgatagatcgtcaaatgatcattcatttttctattacctcgccgccgttgtcagcgttatcaaagccgccggttctttttaactgcaccaaaaccgttgccagaacaggaaatccaaacagccctatgataccgaaaaaacaggctcccacaaacatacacatcatggtgatcagcgggtgcagtccaatctgctgccccacaacacgaggctctaatatctgccgcacaactgtgataatgatatataaaatcagaagccccacgccaagagggatgttgtcggtcaggaagctaatcgcaatccacgggagcaggacggttccaaccccaagcacagggagaatgtctaccaatgcaatgagccccgcaagtaaaatagaatcatcaactttgagcaggaacagcccgacagccagctccacaaatgtcaggcccatcaaaatgagatatgcttttccgaattgctgcaaaaccgaaattcccttttcctttattctgctaaacacttgttttgcttttgggggtaagtgtctgccggcaaaagttattatcttttcgtaatcaattatacaaaaaaaggaggccacaatagtaatgataaaattcatcagcgtttggggcgttttcgatgcaatgcctgtcaccagcgccaccacggatgaagaaacgtttccagcaaatccggatatggcgcctgaaacggattctcctatgtaagcaagcattgtttgaaagtccggactgaaatgttctgcagcggcctccataccatgtgctgccaattccaaagcgggcaaaatcgtattgtcatataattcaggaaaacgcactacggatgttttaataaaacttacaaaatcagcgccaactaccgcaatgaacagaaacaatattgtgtaaaaaaggattagtgttgtaacagaagctgctttacgcccgcagcggcctttttttgtaaagaaccggataatcggatttaagattatcgcaattacgaacgccgcgataaagggcttcagcacaggcaaaatatagccggccgtcagaaaaaccaagcctccagccaggctccaaaacaaaacccttatgataaatttcttcattttttcttcactcattgtttagcctcccatttccgatataaaagcaaggatagcctgcctttactttttaaattattttatttataattccactataaactcttgacttactccagagtcaagagcggaaaatatatatatgaatttttttgaaaggaaattaagatgaggcagttattgaggatcgggcaggtttgtaaactttatggaatatctcttgatacattacggcactatgacaaaattggacttttgaaaccccttgttaccgagccatccggctatcggtattattcttttgaacagcttgatatattggagatgattttagccgggcgctctcttgacatcccgctggagaatttgcaaaaacgactggcttctggagaaatcgaagattatatacttcttgttaaagaacaacagacggtgatagaggaaagaaaacgggaactgcagcagcttgaaaatcattcccttcaaatggcggaattgctgacgcaaatttccttgcacaaaaacgatgaagatttgcagaatatccattatgtagctttggatatggatatttgccggatacccattgcaatgtttcctccggcaagattcgacgggaacgatatgggcagttttctgcagatggaacaatggagcttctatcaaagcgattcaaacgggttcgttgccgagcttccgcaggatgccggactctcctgccgaaacgcggaacgtatgggagaaatgttccctgaatctaccggtgcaaaaatagtgaagataaagggaatttatggagaaactaaatttttagggaaaagcagttcactgcatatttacctgaataaaatcagcaaaagctttcatctgcagaatacagaattgctggtaaaatacattttcgcactgccacatgaagacttggacaataattattttgtagagatttactttccaaagcatgactaaaggctcacccaatccagtcgtattccatagcggcaagcagtgtttcgtggtacacacgaaacgattctgctttttcgcttctacgaaaaccggaaaattttacttatttaggggcagtttcacacttgtaatgaactcggtcccttcgaaacagaaaaacacctcctattgctgtcagcccttcggtcacaggaaatgccagccacaccccggttatacctgccagataagccagcccgaatgccaggggaagaataaggagtaatccccttaacagcgaaattatctgtgcggggaacgctctttcaacggaggtaaaatacatggaaatcacgatattgaaaccggcaaagggcgccgccgtaaaatacagccgcagcccttccactgctattgcctccagctgcctgttcttatcactgttaaaaatccctgctatggggccggcaaaccggaaaatccccaggtaaataccgcatgaaaggagcatcatcgtaaggagcgcatactttaatacccgatttcttccttctgtatccccttttccatagaatctgctgaccaacggctgcattccctgggcaattccggtatatatggaaagaaccacaagagacagattggcaaccaccccataggcggcaacccctgtatttccctgcagccgcagaataatacggttgaaggcaatcataacaataccggaggccagctccgttatgagagacggaaagcccaaaggcagtatggagaatatcatttctgcggacatacctgttttctgcagatggaaccgatttttccctttcagccagtgcatactgagtacaagcatactgatcaccggcgccattcctgtggcaagtaccgctccgaaaatccccatatccagaggaaaaataaacagatagtccagtataatgttggacaagctccccgtgagcatggcaaacatggacagtctgggattcccgtcattcctgacaaaacaaatgcagatatcgtttagaataaaagcgggggcaaacagcattatcacccgtaagtatgtttttgtcatagaaaagaccgccctatccgcccctaaaagggaagtgatatccccggaaaggaaaaagcctgcagccataaatataaaagctgcaagaataccggtatacaccgtattcgtaaagaccgtatttgtgtcacatgacattttctgcccttttaaaatggaatatttggttgccccgccgattcccagcatcagccctgttccatgtataaagctgtaaaccggaatcgccagattcaatgccgccagaccatccgcccccagaccctttgacacaaaaaaggtatccgccagaatataacaggacaaaccaatcatacccagcacattcagagccgtatactgcatgaattccgtaaaagctgtgtgcgtctttttcattttttccttcctccgtccaaacaaaaaacgccggaactttctgtcttccaatgacctgctgacagaaagtccggcgcttatcttttttacccggtggcaaaaaagtgccctgattttattttatttttaggcgcctgtcagagctgtttccctgataagcaattcgtttccctgcattatataagaggaatccatctcatgtcaagcccctgcagcgatttcatttatccaaatttttcataacagtgccttacaaaaccgctcacatttttatcgtatgaagggtattcatatccccatgctccggcgcattcacatgccgtattgcgaaaaagctcatggcacaggaacagagactcccacacatgctcataggagtcctcacgataagtatgcagcagtttcttccacaatgtctccggcagatatttatcaaggaatttataattctttcccacactgaatgtgaaaccataatccagccctgccttccaggaaagcatgcgcagcaattccatccgcataagatgcagatggtctatggcataaaggatttctttcctgcccagcccttttgccacataaagcaccaggttccagaattcgttgcagcagtcatcaaagctccttgcactcggtttctttatatgatattcctgatccgtcggaatgatttctctctccaaacggctatccttatccagcaataccgtccgcaggtcatcctccttcagatatccttccagctgatccagttccagcagagtcaaatccattttggtgtaatcatcaaataatataaggtaggaatatccctcttcctccgccggaaacagctccatatcctccggcttctgcatcataataatacggccgaatgcagaaagccatctgtcatcccgtataaaagattctctgtctgtcacaaaataagtgatatcataatcctgaaaggaatcttgcggtatgttggaattcacacgggagccttccattccaactatgcggatgttttcattcttccgggcaaaatcaagtatcgttttcatgaattcttcgggtgttctcatatttttcccttccaggccccgctgttttgagggggatttatgttttactaattaatgaggtaataaaagcatacatgaacggttcaaggtctgcaaagaatatttcattctgataatatttattatacctacacgaatgtattatttcaacgaaaccgtcaaaacatttcaaatgaatctcccaagtttttacggagattttttagtgatttttcagaaggtaaaatttcagaaaaccattgacttccacgtaacgtgatagtgtaacatacaattaaagaacaaggcaggtaatcaatgccggcaggtaccgcctgttcttaaaccagtaattttttcatactaaaaataaggggttgatattcatgaaaacgataagccaggttgccagtttaacaggcataagcacacgaacgctgcaatactacgacgaaatcgatttgctcaagccaagcgaattaaccccttccggttaccgcctgtataatgatgaagcattagagaagctgcagcagatcctgttttacaaagaactgaattttaaactgaatgaaataaaagaaatcctgcagaagcctgaatacgataaaatagaggctttcaaaaagcagaaaaaattactttccctgaagcgcagccgcatagacaagctgattgcgctgctggaaagactggaaaaaggagaatcctgtatgagttttaaagaatttgatcttagcgagtatatagaagcattggaacaatttaaaaatgaaaagagcgaggaagtcatcaaacattggggaagcatcgaaaacttcaatcagtttattcaaaagatcaaagatgatgagtcaaacgcggcccaacttgccatcaaacagttcggcagtattgagaagtatacggaagccatgaaatataatctggagcattttttggagatcatggagcagatggacgaagtttcccaaaatgcagatgaaatcctgaaaaaaagcgatgagcttttccttcagctgacagccgatatgtcgaaggatgtcacatccgaagaaattcaggacattgtccgcgaaatagtggaatttaccaataaaaacaattccatagtggatatgggggaaggatattgggattttgttataggcagctattccaatgaagcggcaaagggaatcacagagaagaagtatggggcagggtcggctgattatattgccagggcgctgaaggtttattttggaaaatagttaagtaaaatatgtccgaaaataataacgaatatagggagagccgggtttacaggctttccctatattcgttattaaaaccattatttacattttgacgcgtcttctcgtcttaaacaatataaccttccttttgtatactttgatagtaaggaactactcttaacatgcgattataatctataatattctgaaaaaccggagacaatataatatcatattttacattatattcaaaagtaagttctgaaattttatttattaatagataaaattcttccggctttttcaaagtaaataatgcaatatctatatctgattcttcttcatattctcccctggcataggaaccatatataacagccctttttaaatctgctcctaaaatttttttaatttctgaaatatattcattgattatagaatccaattcttctttatgcatatttaaagccatactatcacctgcctttgatattattaagcatagtttattaaacagtgatttgttttaattatacaccataatcacgctattttccatgttataaatcaattatgataccctcccgtatctgctatcatcccctctgcgggtatgtatagtaacagcattcgcgtatttaagccttcttcggcacagggcagctcctcactttaacgtctccgacagaatgctgcaaatagacggtacagcctgaacaatatcttgtatcctccgcaccaaatcctctctgtccagtctcccgaaatcggttgtatccaaaattacctgcggaccatttgccgtaaaagaatccatccccctctgcgtaatcccttccacaaaactctcataggatatctgtaccgggctgtttatttctttgctgcccgggtaacagtcattcaccacatgtcccggatgcctcccgggatcgcggtttctttccaaaaacctctgatatataatcttataatcgcctgttaaagtgaccgtaatcgccttatattcatatttttccagaatggtgagcagcccctcttttgacacattctcaaaattattttccaggataaaaggccgggcgctcctcataagttcttccgccaaatcatacatgatctgcatgctggcagtccccagcttcaccttctcttctctcgaccgaaatccaatcgtatcatacatgcattccttgatcctgtccttcgaaatcacgggcaggccgaaggcttctgccaggaaccgggccatagtgctctttcccgaagcgggaatgcctgttacaagaatacagtacattttttagtcctccttttcgtccgccacatcacaggcaagccccatctcctccgcctgtatcagaaaatcctgtgaaacgcctgcgtcggttatcagcaggtcataatccgacgctttacaaacggaatgaatggaggtttttcctattttttccgaaggatatacgccgatattcatggtgctgctctccataaccgctttcccgaattccacgcctgcacagtcatggatagaagctccgaagtccagggaaaaggctgtatgggacaaaaatgctttgtcgatccggatattttttaccatccggacggtgtaatagtcatggcagtgcccgcgcgaagacatttcccctcctaaaaaaataaccttacagcattcctttttccgtaaaacatccgctatggtcactgaatttgtcagcacggtaacctgcaggctgtccggtatattaagcgccatataatagcctacggaggaggttgtgatatatactacttcctgctgtccgatatattccaatgcctttttggccacgatcagataattctttctcacctccggcagatctttgggggtataggttttctccgggtaaatgcctttcggctccgccggcagagcccctccatgggtcctccggagcagtccttttctttccagttcccttaaatctcttctggcacagtccgcggataccccgtagatttcctggatttcagatacgataatcctgcctgtttcattcagccttcgtacaatgtctttctgcctttcttccataaacatgatgcttccccctcttatcttttcctgttgacgtatattttcctattttatctatattttcttatttattcttgttttttcttatctataatttattgtactctttttttatacaaataacaatcctctgtctccattttcaccggaaaacaaatgcctgttaccatttatcccagccctgcaaaccaaccatattttcaataaaaaaccgggcggaacgactgttttcacagccatttccgcccggtccctgttattttactcacatccagattctgaagcacttgatttcaaaaggtccgaaatccgcatggatcgtatttccttctgtctttccgtcatattcttccagaagattgcaggccgcgtatgcacggactggataatcggaagtaatctcaaccgacgcccggccgcctgtgatctcatgcatatgaaccacgaagccgtcaccgtcctccgcctgtttcaccgcatcaattttcaccgcatcgctgttcttctttatgaacctgcccacctgttcctttacggcaccggctatgcacagcgccggctggttcagcagaatgccctgggtaaaggtttcttctcccaggccgcccgcatggggaagaagtgcgtaggtgaagaaatgctcgcccatatccgcttcggtatccggggattttgcgctcttcagcagagagagccccatcacattgtctttgatgccatagccatatttacagtcattgagcaggcttaccccgtaattgctctcagacagatcggcccacttatgcccgcagacctcaaaccgcgcccagtcccagctggtattccagtgagtgggccgttccacgaagccatactggatatcataggaagccttggttgcgcggatatccacctcaaacagtgtcttcagcagacggtggtcctcatgccagtcagccttcgtgacaaaatcaatccggcggttatcggcatagacaatcatatcctgctctatttccgatgcgcggtaacggtaaacaaaacggattaccatacgcagaggcccgtcctccaggcagcggatatcacatgccggaatatcctcatgcttctgtgtatagtaaatgtcgatatcccaggcatcatagttcataggcttatcttcatagatacgcagtatattgccctttccttttaacacctgcctgctgttttctttatcccagaggccggtaaaggctccgccctcttcccattcgattctgtaataaggcgtatccaggcagcgttttcccaaatccagggcaaaggggctgtccggttcctgtgtcttttccggggcaaaccggataacggaagcggataacggttttatttctgtttccaccagccagccttcagaaatcttctgcgcgggcagaaccgcaccgtcttcatcggtgaaaataccgtctctctcctccggaatcaccactgtttctttgcagtcgatatccgcaaagcgcatcaggctccagctgtcatccgccgtgcggcataaaacatcggccgcctccttctgcatatcgcccacttcgttccaaagcgtttcgtattccctggcggtatcctcataaacctcatggatggaagaaccgggaataatatcatggaactgatcccgcagaacggtttcccagcagtcatgcatacgctctgcctgatacgttccgccggcaaggccggaaagcacggaaagccattccagctgtcccagggcattttccatcttccggttattgcgcttgttgcgggcctgggaggtataggtccctctgtgatattccagatagagctccccgtcccaaaggggtacatagcgatccgttttctccacgttttcatggattttttcaaaaaattcctgggcatttgcggttttaatattcggcatgccggggatacggttaatcgcccggatattttcaatcatgcttctcgtggttccgccgcctccgtctccgtgtccgtaggaaatgagaacctccctgctcagatctttatttttaaatttacgccaggtgccgataatggtttcgggagtgatttctccattgtaggtagagcctctgcccgttacagacatgccgggggacggtacgtccacaaaatatgtcagcatttccgtcccgtcgatcccgcgccaccggaacaggtcgttgggtacggtattatactggttccagctgattttcgttgtcataaaggtatccaggccgcacagcttcataatctgagggagcgcccagctgtagccgaacacgtcaggcagccacagaaaatggcattttttgccgaattcttcttcgataaagcggatcccgtacaggaactggcgggcaaggctttccccggaggtcacgttgcagtccgcttccagccacatgccgccgtccgcctcccagcggccttcctctacacgctgcttaatgccctcatatatttcagggctgtcttttttcagaaatttatataactgaggctgtgtctgcaggaaatgatattccggatactcctccataagccgaaggaccgtggcaaaggaacgctgcgccttctcgcgggtatgctttaaccgccacagccaggacacatcgatatgggtatggcctgtggcatatacagtaaccgcgctgtttttgggcatgtcgtccagcgctgccttcagaaaagccaaagcttcggcccctgtctccggcaggcggtctttatcccagtccagaatagccatcgttctgtccagtgccttggcaagctcagtccggtccgtactgtcctcggcaagataggtaaggctttccgcagcggcggaggccagataataaagctcatccagattgttatccagatagccgatctgcgcttccgcaatccggtgatactgggtgcggacggggccgccgccttccagtcccgaccagagcaggaaggtcataagaaccgtctgtccggcaaaaggcgtaagcaccacttcacggtggttggtgtccactccctgaaagggctgcccgtttatgtacagaagggcctcaaaaccgctgtttccgccgcctcctgtcctgccgaaattaaaataccccatgaccttgcagccttctttttcttcgggtatggttatttccctctgcagccagatatagcggtcgcggcctgcaaattcatcccccagccggattttatcaccggcaaaagcttccggacagcttgtatacacttcatctgcatcaagccctccttcctttgtgtaaaaccagtctacgctctgcatcccggtccatctgcgcccttccagttctgcggcgcgctgtctgaatttttccttttcaaaaaacatgcttcctctcctttttctttcctttttattatttctaagacggctgtccggccatatgccgtacaagcgccctttttacctttcctaccacatctcccccgtttttctgctgctgcatgatcagcagagtcatcttttcccgcggataattgaaaaaacagcagccaagccagccatcccagcagtattctcccctcaggccgggtgaagcagccatggacggctccttcaaaacccgcataagccagccgtagtcaaaccccttctgcccgaaccagcgctcaaaagccgcctgctgcggctgtgtcagccccactgtcatcatctgttccacggattccggcttcagaatacgggttccgttaccgcttcctttttccagaagcatcccggcaaagagggcataatcctcaatggtcgataccaggcccgccccgccggattcataggcggcggggcgggccatccggttccttattccgaggaagcttccctcatagggcacgaggcagttatcctccatccgttcgtatgcttttgccagccgccgctgtttttcttccgggacaaaaaatccggtatccttcattcccagaggggcaaatattttctcctccaggaattccccgaaggttttatgtgccgccttttctataacagctcccaaaatatccgcggatatcccatatttccaggacgtgcccggctgaaaaagcaggggaatctctcccgcccgttccgcaaattcaagggttgtcatggggttatcccccttcagcctttcctccgcttccgcaagcagcttccttgttgccagctctgtgaccgtatcgtcgtccccataggtcaggccggaagtcatcgtgaggagatcggaaatcagtatcggcctgtacgccggttccgaatgatccccgcaccagaccctggaatttttgaagccgggcagatactcgcctaccggcgtatccagctccaattccccgctctccgccagcagcatggctgcggcggcagtaacaggcttcgtcatagagtataaacgggaaatggtattcctggcaattgttattttattttcccggtccgcatatccttctccaagccagcagatctcttttccatccttcagaaacagcaggcttacgcctcccacttcctgcctgtgtaccgcttcttttaagatatcgctccattcttctgttaatttactcattgtctgcctctttccttatgttcttttttatcccggcgatctttcgtcctcccgttaccttttctattcctcaacaccgtttctgtactgagaaggtgttatgcccagttcttttttgaattttctccgaaagctggagacattttcgtatcccacctccagacagatttcctcgataggctttgaggtattccgcagcagctccttcgacttatggacacgcagattccaaaggtagtccgagaaattttcattgaaatactttttgcataaataactcatataggcaatgctgacatgaaatttttctgccatcatcgcaatggataaatccgtggatgtataggactgttcgataaattcctgcagttcaccgctcttgattgtcaggtttgacagctcattctcaaaaagcgttaacagcagcatgaaatggttccggatatcttcgcttttctgttcatacgtaaagcttctgatataataaagcgtttcaaaataaatattattataagcgctgaatttgatattctgctggttcatgctggttatgatcgtcgtcagcacctccgtaagcacgcttcgggaataaaatgcggggaaatccgactgatccagggtatggaaaaattgccggacagcggttcctgcctcctggaatttcagctggttcagaagggaggcgaagctgctcagttcctggtacggatacttataggtactgtcgccctgcacatccatttcgtcgaaaaaggcgatctcacaggttcccccgtaattgccggcctgcatcgcattcgcatacaggttcggaatgtccagcggcgaggatgagccgttgctcagcgcaattctgcagccggaatctttataataatcattcagaaggtattttaatacatttatcttatcctgatcctgaccgccgtaataaatcaggtaagaacagtattccgccgtcatttccagccggatgcagaaggaatcattattgggaaaggtccgcaggaagaagttccggaagttcctggttacagagtccatcccttctccgttttccggagaagatattttgattacaaacattaagctgcccggttccccgttgaaaagtctgtccatattttccgatgttatctcttctccgttttcatttacaatggtgtcaagaacggactccttcataatactgtggtatttgtcaatcttttcctgcatcttcttctgctccagaagtgccgaggaaaaagcggaatccagctgagacaccaatcccctgctgtcattatccgcaccgataaacttcttgctcagccgatgcagcggggaataggtgagccgcataccgaacaggataagcagcagccccacgcagcctgctgcggcaaaaaccatatacatgttgataaaggccttgcttgcatactgaagcaggatgtccttggaaaagcatacggttaaatataaattggagtgcagggggagggtatagatgatttcatccccttcgtcgtttttctgcaggccgaacagattcatctgccccgcaagcgggatcacacgctgttcaccggatgcggaaatgatattgttttccccatccgtgagatatacccctgaaatttcttcagacagcatgttattaaacctcgtgatgatctcgtcggcatcgattatgtagaataattcatattttttgtttgacacgctggggaacagcagcaacagggaaagatcctgatttttcacataaacaatggagttcttattatcatggccgtatcttcccaccggaattttcagtgttttctggttcagggaaaaatagtactccccttttgactggtagatatagtttttgcaggccaggatatttcctccgttattctggatataaacgatatcggatacgagaggattggcactgacaaattcacgcatgtcactgatgcttaaggagctgtaccaggtggagccgggggaatggcgcagcattttcagattggaattattgctgaggttgtaatggatattgaatacgtgatccaaatcattattgaagctctgctgaaaaaggatgagcttttcctgtatgctggtatccctgcttgtggagtaggctgtcctcagctggtttctgaatgctatgaaaaagcagagcagaaggaagctgaggaggaaaaaataggataggaagtatttcaatagggtgtggtagttgattttttcaaaacgtttcctgattttctccatacggcttccctcatttcattgattgtcggaactttttatttgttgtgcggagtgcggcccgctgcggctgcatcccatctgcctggcccggtgtttcccggcgctgaggtccggcccctatggggaccttagaggggacgctttcgctcggataaacacgcagcggtactagggttgcaaaggactcaacccaaggaccggcgagtttatgacgccccttacaggttccccataggggccggacctcagcgccgggaaacaccgggcgggcagatgggatgcagccgcagcgggcctggggggatggaaggctgtagttagggcaaaaaagtgatggtggtatagtgtgattataggctagcagggaggggtttgtaaaggaatggggaggggcggtcactttttgggggctatattctgggggtaaaacttttggggggttagggggtgtatctgcatgtataggtgcctggaaggaggggcttttgggggaagccgtcttcgaattgccaggattgggggaggcggatggtgccttttagttgtgggggggactggatgtttagttggattgtgtcgggtggggcggaggggtggggattttggggatgtgttgggggtgttcggttccattttattgttagtttgccggagggggcctggtaggcggcctgggcttgggtgaggggttggatgaagttgggggccaggaggatgtagtcggggtcatccaggtgggggttggggttgattcctgttattgcgcggatgaaccagctgctgatgtctccgaagaagtggtggttttgggaatgggactgggcttcgggggggaggaaatcttcccatagggaggtggctcctctggttatccagttggcgtaggacgggtagtcttttgtggtaatcatttggtaggcaaggtcggcgtggccgtggtccgagagtacgtgaaagaggacacggaggccaagggctcctgcgtttatgtggttgccggcctggtggatcagctggaggaggcgggtgaaggcggcggggcgttcggcctttttgaacaggccgtagtggatcgccatggcctgggatgtctggcaggcgcctgcggctgtcatggtggagaagtcaatgaggtatttccggaaggactttttgagttgggtcatgagggtgtctgcgtagtggtattcgggttttctgttcagtcgtttgaacaggtatttgacttcttccaggaggtgaactgctgtggcggtggaggtgacttcaacgggggctttgtggcctcctccgctttttccggtttcgcaccagtcgccgaggcctgtgtcgatgagtcctttttcatttctgattccggagaggtaaaagaggtagcggaagataaagggggcggcttcttcggctgtttgcaggtctccgcggagtttcagcaggtaaaatgggacttctgtgatgacctgatcccaggcggggccgcagccgaagccccagcctgcggtggggacgattccggggaggctgccgtcgggggcctgggagagttccacgttatgaagccattcccggagggagtcttctgcggcgaggttcatcagcatgtgttcggccgacagggcggcgtctcctgtccatccgtttttttcgcggtggggacagtctgtggggaaccagaaaaagttggagattgtggcgtttcttgtcattgcctgcagttcattggctgtgggatcggagcaggaaaaggttccgatttcctgaaagtctccgcccatgacatggtatgtcaggagatcggggacggcctggtccttttcaattccttttatataggcatatcggaagccgtagtaggtaaaggaggggatgtagctctcttccttgtttccgcggcatatgtaggtgctgttttgtacccggtcggtgtaagggaagtcatattcggggaacatgaggttctttttttccagaatgccgtcatggtaccattcggcataggatatctgtattttctggcctggctttccctttattctgagttcgcatactcctgcggtgtctgtgccgaaatcatagaggtaaccgtcttcatagggtatgatggaaacggcttttctgcgttcgtaggttttaatgggtgatgcctggcataaacgcatttctccgcggggaggggtcactttgaggaccgggttccatgccgcatccgaaaaggaaggggaacaccagtcgtcgatggtaagtctcgcgtcatagcagtcgccgcttctgagttcattttccaaaagcggggaggtgtgtgtgcggaaggtggtgtcgctttctacggtaaggcattcgccgttgtccagcatcatgtccatgcgcagggccgtcatgggggcgcttcgccatctggctttgtcaaaatcccagacaaaaccgccataggcgttctgcatgccgtttccgaggatgatgcctattacattgtctcccctggttaaataggggagtgtgtcatagcgatcataatagataacgtcgtccgggttactgatgtacggcgcaagtatggatttggtgatttcggttccgttgataaatacctggtaaaagcccagcccggtaatgagcagctccgccgtccggggtgctgcgtccagggtgaatttctttcgtatatagggtgcgggtacctgatggtcaaaatccgcgtaatccgttgatgcactgataaactgctgtggaaaattcatacttatactcccttcatatcgcaggcctgtctgcgatacttctttgatagatcgtttggaagtgtctttcttccacacttctcacttttctcttccttcttatttatttactatgatacatccttccgtatctcttttccaggaaacggaaaccgtaccggcgctggtccgcagagagccttccgcccatgtcagagccttgatatccgccgggtctgcaaaaaggtccgtatatccgcagctgccttccttctgcctgatgccgaggatttcggtaaacagcagcttcaccacgctgccgaacatgggatgatcatgggaatcgcttccctcccatttttcccataaggtggttgcgccgtttttcatcatctctgcaaaggaaatcctgctgcggttggcgagcatagtaaacgccagatccgcttctccctcccggaaaagacgttctactaaaaccggggttccgaagataccggtatccagtcttcccagttctttatattttgcgatcagattctcctttgtccgggccgttccaagtcccagatttaaggcgaatgcattggcggccccgattccgccgcagaaatcttccgtctgtctgtcaaaataagtatttaccaccgcatccctggcctgacggagacgttcctccagccattccggttccttctgatgcagaatccgcgcggcttctttcgtttcctgcagtccctgtatataataatacgtatttacaaatgccgccggtatcatctccggctccgattccggggcacaccattcgcccaggcaccagccgccttcctcttcccggacaaccaggccgttttcacagcgggtattcatgtattccagccagcggacgattgccggatagcctttctccaataagctgctgtccccgtatacccggtaataattcatggggatgacatagaccgcgcagccccagcctcccggcccgcctcctccgccaagaaacggcgccgtatgcgggatgtgtcccgtatcggctccctggctgtccaggatgtcctgataccatttttcataaagctttccgctatcaagcagcagcatggcggtttccgatgtcagctgaccgtctcccgtataccctagccgctcccggtgcggacagtcggaagggataccgttatgaaaattattgatctgggttcttatgtaagcatcataaagccagtttaaaacaggatccgagcatcggaaggaagacagcaccgaaacatccgagcacaccaccgacgcgcttaccgcctcccccggcccctccacttcaaaataccggaagccgtgccagcagaatttgggatgtacagtcatagaagagccgttacagatatagcagtcctcctggatctgcctgtcccctcctgccgacaggaaatccagcccatgcccgctcccgtcaagctcctcgctgtaccttacccgtactttttctccttccttccccatacagcggattgtaacccatccggcaatattttccccgcaatcatacagcttcctgtcaccgttcttttccagcagcaccggttccatactccgcaataccctgtccccgggacacgtctgctccgtgagcaccgcctccggtgcatgagcaggccgcgccggtttccactccgacaaatcggcaccttccctgcaccagtccacctgcaccagcctgagatccagcgtctccccgcagaacaaattattttccgtcacttcccccggcttccaaagagtttccgaatcgctctccaggaaaatttcttctccattctcctgaagcatcgtcaattcataccgcagcttaggaaacccaaaaataaatttcccctcatccacccgtttcgtctgatgataccagccattcccaagctgaaccccaataacattctccccctttttcaaataaggaagcaaatcaaacgtcacatacagacaacgatatcctgtacgttcctcccacaccggataagtcgtatcacagccaagcaccgaagaataattcgtcacagcaggaataaactcctgagcccccacccgttccccattcacataaagcagaaaataccccagcccgcagatctcaatcttcgcctcccccggaagctcctccaaaaagaaactcctcctgaaaagcggagcctcacacaaattatccccctgtatccaatgctcatttttcatcttttctttccctccttctccagtacccctgccgcgccgcccggctcctgcctgcttgccttcggttccgtcctccgccgtgccatcctgctctttgcgttccgcacgcgccggctccggccaggcagtatcccctgaaggggccgtataaaaacgccggtccttgtaccgtgttgtatgaatattacagtaatgagtgcttgatattcctgtcagcgcaaggcggagaagggaggcgatgcggtggcatcgttgaccgacgacaacgcggtgctggcaggaatagcgagtactcattactgtgatattcatacaacacgatacaagattgcgtcctctacaatcttagtaccgctgcgtttttatccgagcgaaagcgtgctcctgaaggggatactgcctgaccggagccggcgcgtgcggaacgcaaaaaagcaggatggcacggcggaggacggaacctgaggcaagcaggcagaggccgggcggcgcggcaggggtacgatcatcccttcaccgagccaatcatgattcctttgacaaaatgcttctgcaccagcggatagaggcataaaaccggaaccgtggatacaataatggagctgtacttcagcgtctgcgccagctgcgtcttcctcatgatttcatccggactcatggagctggttatctgcagagtcatctgtgtggaaagcagcagctttcttaaaatggactgcagcggcagaagctgctgggaattaatataaatcagcgcggaatagaaatcattccagtgtcccacggcataaaaaagcgtgatgaccgccagtatgggctttgacagcggaagaaccaccttcatcagatactgcgccgtattggccccgtccaactgcgccgcctccagaagttcatccggtatactgtttatgaaataggtcctggtgataataatattgaaaacggaaaccgcattgggaatcaccatcgcccatatcgtatctatcaaatgcagtttattcactaccaggtaagtgggaatcagccctccgctgaaatacatggtcaccataaaaagaagcatgaaaaacttcttcggcacaaaatccttccgtgaaagcggatacgctccgcacacggtcagaaccatattaatggcggtgcccagcaccgtataaagaatggtattcgcataccccgtccagatcgttttatactttatgacttcctcataggcagccagcgtaattcccctgggaaaaagaaccacatgcccctgccatacctccgaagggtcactgatcgaagcgatcagcacaaaccagagcggccacacaaaaatcaccagcagcaccagcatgataagcaggttgacaatatcaaataccttatccggatctatctttctttttttaattgatcttattttatccatacctgctcctttaccacaagctttcattggcaagtttttttgataattgattcgccgcgatgaccagcgccatattaatcacagaattaaacagccccaccgccgtggaatagctgtaattattctgaaccaacccgacccggtacacataggtattgataacatcggaggcgctcatattcaaatcgttctgcagcaggaagaccttttcaaatcccacgttcatcaaagatcccatctgcagaataagcagcatgatgatggtggacttgatacccggaagatcaatgtgcagaatcctctgtacctttgtggcgccgtccataatcgccgcttcatgcaaagccggatccacaccggataaagccgaaatatatatgatagagctgtagcccatgccctgccacacaccgctccacacatagatactcttaaaatactgaggcttgctcagaaaatcctgggcttcccctcccagcgcaacaatgatctgattgaaaatccccgtatttttatccataaaaatagcaatcataccgcagataactaccgtggaaataaaataaggggcgtaagaaaccatctgcagcgtttttttcagatgcttgagccttaaataatttaaaagaagtgcgaatataatgggaatcggaaaaccaatcagcagcgtatacagactgattccaattgtatttttcaataacagggaaaaattgaagcttccgaaaaacctttcgaaatatttaagccctacccaggggcttccaaaaataccaagctttactttaaagtctttaaatgccaatatcacgccgctcatgggggcatatgcaaaaacaataaagtacaggagaaccggcagaatcatcaaatacagaatccagttctttttaaaatcatctatgagcctgagccgcaagggcctcaccagctccgggcggagatttttctccttccctttcgtgcctgagacaggtaatttattcacgtccgtgcatccccttccatgtgttccggttttttcaagctaagaggaagccgcagtgaaacggctttcctcttagcttaagcatttttatttacagcctgcctatttcgcattgctgaaagcattctgataaatttcgaacagctcagatgctcccattgtattcattgtggatacgtaatcatcccagctgtcatccagatcgatagccccggtaattacctgtgcgccgtactggttgatgtagctgtcaagatccgcttttaaagatgctatggtttctgtttcttctgtagtataggtcatggcaggaagtgtgagctcgccataatccagcattttcgcacgctgtgtaatcagataggattcatcaggatccgtgattccggtaaaccagaaatcaggctggataccagggaaggctgtctggtatttcaaggttcctttttcacgtaccgttgcaatatcgtcaccgataggtccgccgatattccaggaccaggttccgtccccattatccacataggaatttccttccacaccaagccaatataattctccgccttcctgagtaaaaagctgatccgcccaggcaaccagcgttgccggatcgtcacaggcatccgtaatcatcatgctgccgtgcataatacctgtggactgcggataaacctgacctgcaaaaggagtaagcgtctggtattcttcgtcctgatcacggcctgcaaactggaaggatgcaagagcgctgaagcatcccagcacatccccggagcttcccattgccgcaatctgatcataattctgggtaaagctggcagggtcaagaagcccttccttataaaggtcagtaaaatatcttaaaaattctttgtagccttcctctgtagggatatatacaagcttcccgtcctgaatggcaagccaggtatccgaatccaggttatatccaaaataaggaaggtaattcctcagataagacatgccatccggtactgaaagaggaatttcatcattaggatccccgtttccattggcatcctgctctttaaatgcagttaacacctcatgaaattcatccaggttcttaggctccgacaatcccagattatccagccactgatagttcagccaaatatggaaaccggcttccagctccgctccggtattcagcgcgggcatttcatatacatggccatccggtgcggttatgtaaggccacagctctctttcatccagcaggcttgtaagattgggcgcataggttctgatataatcctccagtgggacaaacacaccctcggctccgtacttatcaatatcatttttcttaagacttgagaaaataaatacatccgggtaatctcctgccgaaaggataagcccttctttttccgacgcatcctcctgaggaatactgtttacatcaaaggtaatattgctctgttcattcagatgcttgaatgcatccacctcatccatgggtgtatcaccattaataatacataacatggaaaaattctttgtctccgcaagcgggaaggttatcccttctgactcccctgccgcttcctcggacaccgccgctgcagaagccgtttccgtcgtcccggctgattccgtagtggtggttcccgtagtttccgatgccttattcccgcagccggacaccagtgacgccaccattgcagaagcaagcagtactgccaacacttttttcttcatagacccttttcctcctatacattggaatatctggcaaattttctttgcaaggttcattataggaatcctttctatatataacaaggacataactcttttcttttattggaaatatgtgccttctgaaacccttgaaaacagggcatttctgcgattcaggaaaatcggacagtacaatatttccatctctttatggaaatattgcaccctgcgggatgttttggggcaattatagaattgaccgttgtcctggcatcccatgaaaaaagcccagccggtttaaaggctggacttaaagttatatgttttattttttctctactgcaatccatatctcacaggtatagccgggatcgtccacatcaggagagggatacacttcaaaatccgtaccgccgcagggctggtattcgctcgccggaaaaaactcactgcttacctgatggtacagcctggtaaacgcctccggcattttcccctcacaccggaacacggcataggtatgcgccggtatttcctctacggtcaaatccgggtccgcaaccggttctccattatagtaaccgccaatggcatagggataattactgtcagccgcatcctttccaaaactggcgccgactatacacttcccgaaaatattatcctccgggatatatctggccagcgtctcaatcgtcccgtccgccccgcactgctgccagaactgagcgagctccgcgccgggcatctccttttgggcggaacaatttatctttttgcatacgattgggaatgcatcctgtatttcaatccggtagtccgtcatatgacctccgtccatggttaatttcacaaaaagtcgggaaaaggatttcagattggccccgtttcttacctgggaaggagagacaccatgaaaacgagtgaatgcacggctgaagctttcctgtgtatcatagccatatttcactgcaatatccaataccttcgcattcgtggaagcaagctcatttcccgcaagagtgagccgacgcatgcggatataatctcccagagtatagccgcacaggatactgaaaatacgctgaaaatggaaaggggaggaataggcctgcttcgcaatctcattataatccaggtcttcggtgatatgagcttccacataatccacagctttttgtattccgctgatccaatccattttctctgactccttttctgcagcagcattgcatgaatattacagtaatgagtgcctgctattcctgtaacactgtgctgactatgcaaatatagggactatttgttctgtgagcaattccattgtcgggacctgtctccgtataaaacaggaagtgattgccacggtcaacgccttccggggatttaccaaaatgatatttccggcatcgccgatggctgcatagcaatggtttccgccgatttcaagaagccaccacaggtaaccgtaaggcatttctccccagcggcttttttcacttgtactctcttcgatccaggcggatgataacagccttttgccatcatatacaccgccgttcctgtataattcaccgattttaaccatatcccgcgggctcagacataggccccatcctgcggtattcacacctttaggatctattacccagccggtaggatggtattccttcaggaaggcaaaatgttcctctttattatgcaggacgatattgcggggcttttttattcccagaggggtaaaaagccgttctgcggcaaaatctgctatcggcattcctgtggcatttacgagaattcctgacaaaatctgcacgccaactgtggaatacttgaattcgccggtgataccggcccgtcctcctaataagtttaaagctgcctgtacccagtcggggctggaatacactttggtgtagggctccgatttgtatttgtatggcgcggtcattgtcagaaggttttttatggtgacatcctgaatggttttttctccgcgtttaggcttatagtcggggaaaaagtcgaggactttttgatcgggggtttggatatagttgttatctattgctatgccgattagggctgataagatgcttttggttactgacatgatgtgggtagtgtcgtcaggagtgtaaccgttgaaataggcttcgtatatattttggccgtttttattgactgcaatgcctgtaatgttactatattgggttgtaattagatcgtcaagcgccttgatttgtttatccattatttcctccgatgggattcgttctgtatagggttatagttagtgccgaattcattataggaggaaatgaggagaagggcttgactttttgtgcgctgaggtgttatgagggggagaattggaaagtctgtattctctatatttggggttacatttttctcgagactgtctatttaactgtgtattgtcgtaaattggtatgtacctggttccctttttcggcactccgcgatttggttttacctatgtttgcatgacagttttttccaaaatacgacgtttgtttctaggaatagtattgccgctttccggcaatactattctatttttccctttattttttcttcatttatgatggcatcattggaaccaaatacgatattttgctgatagatcttttcgatctccctttcattgtaaaatccaaataacatttccaggatcacctcaaactgttcctccgtcaacggctctctatcatactccataactcgatatgctacacatgcgtatgctgtcgctgcatcatgtgtcataatcccactctccttccacacaattctcttattgatagttattaccgtagctgcaggctttattcaataacaatccggaacaaagcctgcatctgcggtattttgcgttaacaagaggatatgggaggggacggccccctgcacgatcctctcaggaagatcgatcgttctctcaggcgatggatgccctgtcgccgaattcgatgatgaactgtccataagtctcgccccaatcccgatagggcatggaccacttttctgttatatcccgcgttgtcagatacaacgttttccttagtgcttcgtcattaggaaaaacggctttattttttgtcactttcctcagctgccggttaaatccctccagggtattcgttgtatagatgaggcggcggatctgtgccccatagctgaaataggtggagaggttttcccatttcatctgccagttctcaaccaccgcacgatacttcttccagctgtccttcatcgcctccaggttcctgaatgcgatctcctcactttcggccccgtatacccgcttcagatccttcataaatgccttggaatccttataggctatatatttcatggtgttccgtatttgatggataatgcatagctggatccttgtttcaggaaatacggttttgatcgcatccggaaatccctgcaggccatcgatacaggcaattaggatatcttttactccgcggtttttcagttcattacataccttcagccagaatttggcaccttcattttcaccgatccagatccccaggatgtcttttcggccttccgcgttgatccccagagcgacataggatgccttcgtgacgatccgcccttcttcacggactttatagtgcacagcatccagaaatacgaccggataaaaaccatccagggtccggctgtaccactcccttgcttcctccatgatcttatccgttatattagacacggaggccggggataattcaatcccgtaaagtgcctggacatgggatacgatatcacgaacagtcatccccttcgcatacatagagataatctgtgcttccagtccctcttcgatgacagccctctttttaataacttccggttcgaattccccttccctgactcttgggacatcgatgtcaatgctgccgtaagaagtctttacttttttaggggatgttccattacgctgcggggtattccccttacttttttcatctgtgatataatctgtgatctcgctttgaaggatctgttcgatcgcatcctttaccatccgctggacaagtccgtttggccccgtgatatcctccatggtactgcacttggaaagttcctcctgataattaaatcctgatgtcatatctcttaacctcactaaatttatttaccaatttattccactaacatgcagtattgtcagtaatgctgatacctattcaaaaaagaggtgtgtcgaataatctgcaagtgatacacagtttatttgacacaccctttttctcatgcaaaatttttagaactaaaggcataccacctttaaacactatttttaaaaaatataaatttactcattttaaaatgaactttctattatttgaatatatcactatttttatcataatataatggacttatctcgttatgacgttttaaccatcccttatatccttcaagttctggtccacctatatttattgcaaattccataccccataatataataataaaatataactctgcacatattgcatcttcactatatacaattttatcatcttccgtaacaaataaaaaatcacactcataaattacttgtccaatctcaccatcattatattcccagcttttattcatcttatatattcttctaatattacacggccaatctggtgtggttccttccctggcatgccttctaatcaagtcatattgagaatcattaattaggtattctaacccctcatcacgatgtttaagtttctctgctagagcttccaaagcaactttggctataaaacgagaaattaccttgttactttttataatgttattatcagtaaatgcaggcagctttacctccatatttttaatatcattgttttgtattttactaaatagttcagggggaatctgcatgccattataaatttcatcattttttataacacgttccattttaacttcatatctttcatttagaattccttcaactattggtattcgttttttcttatttggtatagcctgctgaaatcttaataatctaatctcatttaattgcataaagggcttttcaacttctctagcaaaataattattacacttatcacatacataacctatgggcaatataaatttcttattccccaatgattctggaacaatatgttcaatacttttagtattagacgaatcctgcttgcaaaacaaacatctcataagttctcctaaaatgacatttaaaatttattgattaaattaatatttatattaatattcctgtctatgatttatttagtccttcatgaattctttccatcattaatttatctatattcttagagtttaaatactcagggttatgtgctaaaatatttattgcatatcttaaataatcaatagccaagactattggagttatttctgttttatcatcaataataattaattttgtagcaggtctaatttttcttgaatgtactatatcagagcgatatctatatatttgtgacattgatttttgaacttgcataggcgtatagggaaaatcatcaataagtgttgatatagtagccattcttgacgatattttataagtcaattctcccttgtcgttatcacttaataataattccaagcctattattgcatctaaaatagtatcttcctcgttatctctcaatacgcttctattaagtcttttaatggctaaatccaatacattattactattatcaataagtcgattagctagatcaactatatgagcctctaaatctttcttgattattagatgttgctttagccatgaaaaatcaataaattcttctggaaattcctttgccttagctccggttaatcccattaaatcccctttacaattgcgattaatccagttattttggggccgacatacaaattgcgcatatcccgtactatatttactaatagttcgtatgcttgcaaatattgcatcaataacttggataggatatgcagatttattttcaaaaatttctgtgctacgaaaacttttattttcaagtgtataacctttaattactatcatatgtgttgcacaattgattactatattttcaaaatgggaatcataattccctatattggcttttgatcttataaactccaatggcattttctcaatggaaattacatcagatatttctatattgtcactttcaaattcaatcatcaatataggtatgcagatatcaaattctaattgtttaaggaaataaatattagttacttcatcataaatagaattaaacttttctattgaatattctgtaccaccatatatacttatataacgatccacaatatctccaattattaaaaataatgctatgcgatttctatctttttcaatgttcccctcataccataaacgcttactaattgtttcattactaataataaaatctaataactcactaaatccacaaacttcatctatcaatattttatcttcatttttatgtaaagtaataaccgatgaataatctctatattcataatcagattgtaaaattcctgaaagcaaatttgttttatgcacctctggccatttagttgaatcatctctttttgctgatgtcggataatcaacattactcataatcaacttatttgcatccatgtattttttaatatttattaacaaatttttaactacaacttttactaattctcttagttcatccatcaaatcattttctaatgtatccattctccatgtcccctaatatttatttttttagtattttgtttctcttaataatataaacaaaaagcaacatatataattaaattagctaatatcatcagtatgaccatccggtaattctgttccaacttttcttgcaagttctactgtctttttgtaacacttctcgcttccgattacttttccatctctagtagaaacataattgattatccattcctgcccttctatattatatagacattgcacttttgctatttctatgttgaaattatttgtaaatgtttcaatttttgcttcaatctggctcaatttttcattctgtaatgcctcaaataaaatatccggtatttcggtaacaacaactaactccattaagtaagaagaattttcccttataacatatgtaataggtctatagctttgcttacaacacttaaccgtttttaacacagccttcttaattaattcatatagcttgacaatatcatccgttaaatgttcagttattttcttccccgtcattgcagctattgttccagctaccaatgtaaatattatttctggatcaggaataactgactttctcataaaatattctgtctcaaacaaacattctttttcgtaaaaatttaaaagattttcacaatctgtttttgagaaattaacaggatcaatagaaactttaatattatgaatatcctcggcttgagtatctgcaaatggacgaacatctctttggctttttgcaatgtaccatttttcgcctgtttcatcactaaaaacttgatactcgtcaaatagctcttgttctatttctattccatattctccatctttcaattttaccattttcccacttattactttacctataggcataatggtagaatcatgttcaatacctactcctattgcgtataatccttcattaatatcttttactgcatcttctaatgcttcttttgcaatcatgcaattatgtttatctatatgtgttgttgcacctatacctttaacaatcatattttcctccaaatttaaaccgtaatttaaatattttctattttgtattattgtatactttaattaatagcactatattagctgacgctaaatttagtgcatattctgcaaattcatcaggtatatttaccactaaacttccttggccatgaccagcatttttattacgcacaacaggcaatccagtttccaacgttgttctaagatttgtcagatgtgctgacatatatgccggataaaaatggttactttcaagtatcataatcagtttttgagctgtatctttaactttatcatatgtatatcctttcaaatcacaaattgttttcatagtgctttcaaaagcctttccagcttctaaaattgcgttcttattatccgactttcttctatactcaaaagcctttctaatttcttcttctgcccctataaaattctcatcatataataatctaagtgccggcttaataacattatgatgtatgactgtattatctattctgatcaattcactattcacaaactcataccctaatctatgctgcttaaatctatagtttaattcttgaattgctttgtcaacattagtattagaattattttcataactatatcgctgctttacatctcttaatactgaatcaaagatattgaatgtataatcaataaaatccaacaaatcctcactagatgaattatccaaataatattctatattatgttcaccataattagcccatgttacctcataattccctaatttttttagtcccttttctcttgcaaaactgtcatgtataaatccccacatatcactatggtcattctcaaaatatagatttaatacatctgaaacagtaaaaaaaacttgatttctaaattctcccgaaaaatcatcataaatgtaaatttctggttctccattcatatttttcagtctttctgacaaaagttcaaacataaaattactcccttgttcttcaataataatacatcctttaaaacaggatccaatgcatattaatatcacctatatcattttactcgtttcaaagcccaataaaatcaacttcccaacgatcctatcacgtaacatttaccgcttatcagctatccaacaattctttataactcacgcccaacacctttgcaataaccttcaactcaatatctgtcacaaaccttttgccattctcaatcctttgcacagcgtttttatctatatctagccccgccatttgcagcatatcagccaacttcctctgtgatgttttctttggaagccgttcccggatttcctttactttctgtccgcatatattgttttcaccattagccgccctattcttatacataaatcctctcccgtttgacatttagtgattgtcatttttcatattatatgctaaaaaacacaaaaattgacattcattaaatgtcaatcattatattttaacaaaaggagttcatctataaaatgtatcttattagaactatatgaaggaaatatttttcctgcagagcagtactctcccagaagtgaagaataccgtaaaattcatcaacggaactatcatcattacgacaacttcattgtaactttaagtaagttagagccgccgcttgatatacaatttattaaaatcatggacgatcagcttgacgttatcccctatgaattttcggaaatgttcactgacggttttcgcttaggcgcaagaatcatgattgacattttccaaggcgatttaggtatcagagattataaaccttccgctaaatagcaaagctccaccagcctgtcaagggtaataaacggctgtcgccgcccttgacagactggtggggctttgctgtatagcgcctaagaaggctttaagcagccctccggctatcaatgggcttctcgattctgtttccttctttctgtccgcttttgctccttcaatagttgtaacgcaaaaaaccttacccattttcagttgtcatttctgaaaatcagtaaggttattctgttattgaagtattcttttattcagtgagtgatacctaaaatgttgccaaatcgttgccagtatctaaataaatttgcttaaaacccgcataaacactaacttcttaaagtcaattccatcactcgaattcaatcgtagccggcggcttccccgtacagtcataaagcacccggttcacattcttcacctcattcacaatccgactgctgaccttcccaatcaacgcccacggcagttccgcgaattccgccgtcataaagtccgtagtcgtcaccgcgcgcagcgcaatcgcataatcataggttctctcgtcccccataaccccgacagaccgcatattagtgagcgccgcaaaatactgatccggcttctcatccagatccgccgccgcgatctcttcccgataaatcgcatccgcatcctgcagcatccgaaccttctcttccgtcacctctccgataatccggatagccagtcccggacccgggaaaggctgcctgctgatcagcttctccggaattcccagctctcttcctgccgcacgcacctcatccttaaagagcagccgcagaggctccacgatttccttaaagtccacataatccggaagccctcccacattatggtggctcttaataaccgcagatttaccaaggccgctttcaatcacatccgggtagatcgtcccctgtaccaggaaatccaccttcccgatcttcttcgcctcttcttcaaacacccggataaattcttctccgattatctttctcttatcttccggttccacggctccggccagcttctcataaaaacgctgctgggcgttaacccggataaaattcaaatcataggagccgtcagggccgaatacctcttccacctcgtccccttcgtttttacgaagaaggccgtgatccacaaacacgcaggtaagctgttttcccaccgcttttgacagcagcactgctgccacagaggaatccacgccccctgaaagcgcacacaggacttttccgtttccgattctctcacgaagcgcctgtatactcgtctccacaaaggaatccattttccagtcccctgcacaatggcagacgtcaaacaggaaattagccagcatcttctttccttcccgggtatgcaccacttccggatggaactgcacgcaatacaggcctttttccacattttcagccgcagctaccggacataccggagtagttgcttttatttcaaatcccggcgcaggctgggaaatataatccgtatggctcatccagcatacagaagtctccgatacattggtaaacatcttcccacttgtatcaaaatgcacctccgttttcccgtattcacgaaccggagccgtggatacggtgcctcctaaaaggtggttcatcagctgggcgccgtagcagatacccagtaccggaatccccatttcaaaaatcgctttatcacaggaaggagaatcatcgccgtatacgctgttagggccgcctgtaaaaataatgcctttgggatttctttcacggatttcctccaggctcatggtgtaggggtgaacctcgcagtaaacgttgcattctctgactcttctggcaatcagctgattatactgtccgccgaagtccagaactatcactaattctctttccatttttcctccattctaccgccatgcggcgtgttcgtacttttggataaaatcgcaggtaacttttttaagtaaaataagtatcatataaaaattcatttcattataaaatactcactgctgtttgtcaaaaccttttctttcccgtatcttccttattttatgttatttttcatccttcgtttatttccatccgcacggctgtcattctttcgtacaaaaacagacagcaggtttattgctcccgctgtctgttcatagccgtttcccatttgtgtccccggtaccgccatatatagcagattgcccggaacacccagtcgattaccatagctccccatacgcccagcagccccaggccgaactggtatgtaaacaggtaggaggctcctacccggaaaatccacatggaaaggatggcaatcaccatcgtccatataacgtctcccgccgaacggagcgtattgggcagtgtgaaggagggcacccagaaaagcactaccataatattatggaaacgcatcacatccgttgccatttttgcggcttcaggccccaggctgtacattttaaccagcacgggcatgcttacatacataatcacggaaatcaccgcggtaacgccaatggtaatcgccatcaattttctggtataatatcttgcctgtttatattccccggctcccacacatacggccgatacggataccagcgccaggtttattgcctgtccggccaggatattccaggacgccagcgtattggcgaccgcgttggcggcaattgccgatgtccccatagtcgcaacagcgcttaaaaccatgattttgcccagctggaacatgctgttttccatgccgttgggaacggcgatataaagaatctttttaatcaaatctccattgaacttaaaacggatctgtccgcagaaattaatcggcttctttggattaaacatcatgcagaaaattacaatggctcccacaaaacgggaaaccgtggtggggatagccgctcctgcaacgccccatttcaggccgaaaatacagatggcatttcccgtaatgttaatcgcgttgattaacagggaaatccacatggttactttggcgttattcatggagcggaatatggcggcacaggaattatagattgccagtcccgaaaaagagactgctgttatgatcaggtaggttttggcggactgcattacatccgtatctatttttccgaatataaggcgcagcagctggtcgtggaagccgatgaacagcacggatatcgccagggccagcgttgtggcaaacatgatgatctgccaggctgccttactggcttcttccggatgcttctgtcccaggaaatgcccggccaccaccgcgccgcccgtggcaagcgctgaaaagatattgatcagcaggatattcacggtatcaaccagagacacgcccgatacggccgcctcccctacaacggaaatcataatggtatccgccataccaaccgctatcgccaatgtctgttcaatgaccagaggaataatcagttttttcagatccttatttgaataaagcattcctattttccgcccctaatttttttcttttgtaccttacaaatccttttcgcttttttaacaggattattacttgtttattgtattccgttttgtgactggtgtaaatacttttctcttgttgccagtccgccccggatatggcgctcggatttgttcacatccagcacctttctggcttccctggccaacgcgggattaatctgagacaggcgttccgtaacatccttatgtacggtagacttactgatgccgaactgttttgcggtttggcgcacagtggcattgtaatcaataatatagttggcaatatcgattgctcgctcctcgatataatctttcacggatttcccccggaaaacttgtttttacaatgtatgcgggtatgaaatccagtatgtcaacttttcaggacgcaaaaataaaaactgatttccgtttatcttttctcccattctttataggcagcttcccagtccatccccttcaaatattccccattaaaaaggtaactgcccaaagtaagcggttacctttatatatacaacatatatttccttttgaatcttctcatcctttcaagcaaaacactgcatatagcggaacactcttaattccgttctcaaacccaaagttctttgccgacacccgtaccgaatacgccggttcatagagcgaaataaaagttttcaagctctttgcccgcacattgtctgccgacttacattccagcggaacaatatttccctgacgatcctgaaatacaaaatcaagttcagccttaccctgggagctccagtaatagggagaaatcccatttgtcactaatgcctgcatgacgtaattttccgccagtgcccccttaaacccgtcaaaactgggggaactgcttaaaactatatttgcggcgatctcaaatttagaacaaagaagtccggtatctaccatgtaaaccttgaaggaatcattgtctgcataagcgggcaggggcattttcccctctctgacacgtatacacttattcacaattcccgcagtacgcagccaatccagaggcgtttcatattcataagcccttgcgccggatttaatgactttatactgaaacttcctgttttcctttgcaagctgggcgggaatgcttgcccacgccgccattatttttgtcgtttcatgaggcgtggcatatttggccatatccgcaatgtaagcatcgttcaggcttttctgtgccgcgactacaaaatcaaaatccttcgtatccatatactcgctgacagccctcggcataccgcccaccaccagataatttttgtacaaatccatggctgtgtcatgaagggggtttggcaaaaagtcctcataacattctttgataagttcgcacatcttcctgttatcagttgcccacaggaactcttcaaaatccaatggatataaggtaagcatatccacctttcccaccgggaaggaatacttctcacggtttaacgccacacctaacaggcttccagctgcaatgatatgatattccggcgcttcttcgcaaaaatatttgagagaagtcaaggcacgctcgcagctttggatttcatcaaaaatcaaaagcgtatcgccttttaatatagtctgcccgcttttagcagaaagctcacgtaaaattctctcgcagtttaaatcacgttcaaaaatagctgctatttccgtggaaccttccatgttgatatataccgtatttttataatattgcttgccaaaggtcagggccgtataggtttttcctacctgccttgccccataaattaaaagcggcattcttttggggctgtttttccatttgatcagtttatttaatattttacgttccataaaatgttatctcctcacatttattataactatattgtgctatatggtcaacatattatatgcaaaattatcaagcttaatctattaaaaaagcatctgcaaatagggaaagaacttcccacttcacagacgctcctataaaaatcgcttctttataacctatcttaccatccacaaaaaccgttcccttttgttatttcctcctcctcacctcccgtcagccgcatatatatctcctccgcatccatatccaccagttcctcccacgaaaccgtatcctcccacaccagctttgccttttcttcccccaaagccgcgataccagccaccgcatccagcaaatccctttcacagtcctccagcatcttttcaaacagctccccggtaacacgcagcatctcagaggccttctccgtgattttatcatcggaccagcctgtaaaagcgccgggatcgatgtcctccaatataaaatcatagttctccgacatgttttccagcgtgatccaataatcattgacgaacccgtatttattcagtgcactgcccagtttcatgctcagccgccgtaactctttatcttcttccataactccctcaccctttccgcaatcccgcactcttcaagaatttccgtccctgctttagccacatccgctacccaatatgtctcatgccggtactccgtttcttccagacatccttccgacttcatccgttccagctgccccgcggtgaagctttcaggaaggatatccaatattcccccttctccggccgcatccagcaattcccagaaaactgaagtattatggcgtccacccagtacttctccctgagtgcttacatcacacttaatctccaggcttaccggaatctttttccacgcatccactccttccgccgtttccatacgttcacagtatttttgtgccaacggcttcagcgcatagctcaccattacttccctgtccagttccagcagcccttccagcgcctcctgcccccggtatgcaaactgccagtcataaaacttcgaatccggatcatcaaaccacaaccggcataagcatttcttcaccgcttccgtacctatggcataaaaatacaattccgaaacaagaaacaaaccaggattcaccacacaataccactggttccatttacgcagaaaaccgcactcacacaaagtccttaccgtctctttctcccgccccgcaaaatatctttccactttctcttccagttccatttccgacaaaataacagactcttttttcacaacaggccgcaggcttttgacgaaaaacgtaaattccatttccgaaatccccattttcccggccagataagaaacaatatccatcagcgcatccttcaggttatccgccaaccgccccttttcttcaacaatattcataagcagaaccgccccggattccgttttcagaaaatcagcccagtaccatggttcctcccggtgtccgatctccagcagccgcagcttggtatccttatccacattgccgtaacggatatattcccgcacggccttccagtcttccctgtcaatatcctccatgcttttccggaactcttccaccgtctcttcataccggtattcctcttcctcgtcttcctccgattcctcttcccattctatcttatcctcgtccagccaggaggaatatttgttctccttttccgtcagctccccactgaacgttatcgccatctcttcctggcttttttctatctcatacagaagctcctcaaaatagaacacattattctgcaccgctgccaggcacatctctcttcgataataccattccagataaccggtaagctcttccctgtgcgccgccgcataaatattgcctgcctccttcagtgaaacaggcagatcccccagctgaaaaggcagcccgtttttcatcatcgctttcagatagagaacaattacttcctccttcccctcatatatcctgcgttctatagcctttcccgcggccttgggaaattccttcaaatcctccgtactcatatcctccgaagctgtttctacatcatccagcagctttcggaacttctccgcaaaccaatcccggaaaggctctccccaaatctcccggtacccctgcagcagttcataataagaatagtactcccgatcgtattcaaaaaaatacctgtcttccagagaaaccgccctttccatcaccctccggtaatattccatatcggtttccgccttaatactgagttccagcagactgctgccgcattcaaaataacagctgccccgcagcagcatatccctgtactgggcaaagttccggcttatgtactgatgaatgaagtcttttgccgaagggttctggaatcgtacccgcaaagcatttccggcttccggcactgtctccgtacagatcactgtcttttccagttctgcgatcacgcgttcaaattcccgatagagactgccttctttttcaccggccacagccgcctgatagcatttatgggcatccgtcagattcaccggaaggggcatcagatccatgagcatgaaaaagattctcgcctcgtcggaaagattctgaaaaatctgttcccagaaatcttccggctgacggagatactgcagcagtctgtatgcacactctttcggctcatcctcaggacggacggaattcaggtacatctggatgatccggggattataataggaagaaagcactgcctgatcatgaatccaatacagctccttcatctgttcccaggtcagagaggctttccggaggtgacccagatagatccgcaccatttccgtatcggaataagccttcagcctgcattccagcttatgcctttccagaaggctccgtagctcttcattctgccgcatcccctgttccagcacatattctctcgttgtcatgataaggatgaaatccgtgcgtgtccgcacggtttctatcagccttgcaagccgtctttcctctttccccgtcccgtatgcgttcaggaaattgcttccccagaaatcatcgtaaacaaccacctttttccccggcatatcctgggctttatacagatctcccaccgactccgcccacaggtaggtatcaaagcccttgcgggacagccagtatatggccaattgattggcaagggttgtttttccgattcccggctctcccgatattatgattgcccggtttcctgccagaagcctcctggcctcttcatatacggcggtttccacaaaaacctccgcattctcccactccagccgggattccgccagcagttccccgttgaccgcatctcttatggtccgcttgagcacatctgtattctgaatccacagcttataatatttttcctctgcctgggcatatccggcgtcattgctgccaagatagccattcagatcctttcccgtcactatatcctcatcggcaataatataaggatggaacagctcccggattttcttcttctgctccgggctcacatccctggacagcacaagaatataccggtccggctttatcctgtccgcttttttcttctcttccctgagctccttccagcgcagggcgctttcattggcccacctctttgcctgcatgacaatacatttcccgtcaggcgtgatacatcgggcatccattccctgatccggcccttcccggaacgcttccaggcgtattttttcccgcacctgtatcatatctctggcaaattcctggaattccacaggctccagcagatgatggaaatcgtaattcttcatgctgcagcctcctttcccgcttctttggcgccgcattttacctttttccttattttaccttataattcccccattctccacctttccctgcaaaaaaaatacggcagtcccgtaagcccactgccgccgtcccttcctgtgggcgcacaaaaaactcccgaagcgccgccgccccgggagttttttgccatatcacagagaataaatccccacatttcttccctgtgatgagttgcctgttaatgaataagccttgctatagcaccttccacaatgccccataaggagaaatcctgtccgccgtataccagcatccagttgttaatggtgttcccgaagaaataagagccgaagccaaccaggaataccatgataataccgctcagggccgcgcctacgatacagcctctgataccgccggttgcattgccgatgatggatgcacagccgatttcaaagaagcaggtgaaggtcagagggatgataaccgtagggaacatccctgccgtcaggataatggttatggtggaggtaatcattgccacgataaacccgataatcagcgcgttgggcgcaaaattaaagataaccgggcagtccagggcgggaatcgcaccggggactatcttttccgcaatacccttgaaagcgggcacaatttcggaaatcagcatacgaacgccgagaagcatgatggtaacacctacgccgaagtaaatggccttagtaaaaataaaggtgaaaattccggttgttccgcccgcatagccccacacctcgccgggcacaaggccattagccttcaaaataaagaacataacgatataggtcaggcagatgacgatggagcctgttatggatacctcacgcaggaaaccaaggctcttggggaatttgatatcttccgtggaatgcttcttgtccccgatcagttttccgagataaccggaaatcagggaaagcacggtggtgggatgtcctatggtaaagctgtcgtccccggttacttccctgaccaaagggcgcatcaggttcggggatattaccatataagccgccgtaaaaatggttgccagaccgatgagcttgccgcctgtcaggcccgcgtccacaccggctgcgataaatacataagggaaccagtacagcatgtggccggtaaggaatacggatttccatttggtaaaacgggcaaagagcaggttaaaggcaaaggcgatcagcataacaataccgatctgcgtgccgtatacggacatatcaatgtccggcttgccgcttgccgccggcatcatggtattaaatgccgccgccaggccgtctatggaatttccggtaataatcccggtaccttgtgacagcacaaagaatccgattgccgtcatcatggttccccggacaatctcactgaactgttttttctgcaggataaggccgatcattgcaatcagagccaggaatatcgctccctgtccgaatatttcattgataataaaattcaatacaaccataattctctctccctcctgttgcttattctatttttccaggctccggaagaactccagcgttttctccgtcacttccttcttattcacgaagttgcagatagtcacgacgggtacggtgctgcgttccgcaacacgggctgcgagctcctccgatgtaaaaatgacatcacagggcgttgacgtacatgtgcccacatctccgcagaagatctccgcttccagatcattttcctttaatacttcctgtattttcattttcaggaataaggatgatccgcagccaaagccgcaaacggcctgaatcttaatcattcccatgcttttttcctcctttctcaatcatttttcatactcaggcaggcacatctgtttccccggacataatccggagcacttcctccgcgctttccgccctgctgatctgctccattttttcctccgccagcagggtttccgctattccggacagggtgtccagatgggaagtgctgtccgtacatcccagacataagacaacggacaccgggtcattgggtgaaccaaactcaaccggagtttccagggttatcagcgctacatcactttttaatacctcctcacagggagccgcgtgagccagcgcgaacccgggcattattacaatatagggacccagctccctgacagactgaatcatcttttccacatacgcgggccggatgcttcctgcttccaccagaaccgctcccgccttacggatagcctcctcccagtcagccgccttttctttgatgcggatatggctcttattgagtattttatccaaagacacgacctccttttattcatttttgtacatttagcataccattttcagaatcaagcgcctagttcatgatctttcaacaacatttgaagaaaacttgccttccttattcggctttctgcctatataatgaaatcatactggagcctttgcagactctccggcaaaaaatccggctgtcctccatggacttcaggccgggcaattgccggcattccttaataatacggaaggaggtaccccgtgaacaggcagacaagcaagcttctgaacatactcttaaattcacccggacaatattttcattatgaagagctggcggcacgttttcaggtgagtacccgttccatacgcaactacacgcaaagcatactggatttccttgaggatctgcatatgccttccgctcttaccgtttccgaaggcggcatcgcctttaccggaggagcggaggaaagcagccttctgctccaggccgccgtggacaacgacttctatctctaccgcctgtccccggaggagcgaagccatatcatcctattaaatctgctgatcagtgatgattactgtaatatttatgatttatcggaaaaattcaatgtgagccggactaccatattgaaggacatggaacaggtcaaggcctttctggcaaggtataactgcacctttgatcccgccatgaaccggggctacctgctccgcctgagagaacagcagcgcagggacatgattgtccgtattatccagacggccatgggtgctgtcttttccctgcaccgggaagtgaatatctacgagcgtttcctctatgaggaatggagcctggaaacctatttcccgtttctgaggcagctgcttctggagatggagcatcaatacaatctggatgtatccgatgcctgttttgaagaactgctgctgacgctggctatcatcaccgtccgcatggaaaaggggttttgtatccaggaaagtacactggaagaaaaaaccttccagaacctccttgtatatgagctggccgaaaacatcctgaaggagctggaagaccgttaccgcctgtcctgcagcgaagcggaggtgcagtacctggcgtccaagctttattactgccgtttttatgccagcgcgcccattgaggatgcccaggatgtgaagctgcatatggcgctgaccagctttctcatgatggtcagcagccagctgaatattcccatctacgaggacgcgaaaatcgtcaatcagctggaaagccacctgcgtgatattgacaaagcccatgcggagggcgtccttctggaaaatgattatacggatcagatgattggggaatatccggaatattaccagcttatctgccgccacctgtccatcctggagaacatctccgggtattcctatacgaaagatgacattgctgtcattttaatctacctcgtggtggcagtggaaaggcattttaaaaacgatatccttcccaaagtgatcgtcgtatgccataccggaataggcacagccaactttctggccgaacggctgaatacctatttccacatccgcatcatggcggttacctccaatcaccggctggcggatgtcatgaaaaattatgactttgatgtaatcatatccaccatcaccctgaaggaaccggaagatttgtgggtaaaggtgtccccgatgctggaggatgaggatatcctcaggctgcagaagcttttcatggatatcaaaagaaataagaaaaaactgggtacgcccaaccagctccggctgcccgcgccgggcatccgcaccgtcctgcgggaggaaaatatcctgctggatgtctgctgcacggactggaaggaggttatacagaaagccacggagcctcttctggcggcaggaagcatcgacgcccgttacatcgacgccatgatccgttcctacgaaaccaacggcgcatattttgtttactgtcccggcgtggctctggcccatgccggcccggaggacggggtgcgtttcttcggcctctccctcatccgtctgaaaaagccggtttccttcgggcacaggcagcacgatccggtcacctggtgcatctgcctggccatccaggaaaaggatgagcagatccaggaggtgctgcgcctgatgaatctgctggggaatccggaaaaacggccggagctggatgcgattgcctgcagcggggaactgctgcagtatattatggaaaacgaataggaggaatgaaatgaacagtaagagctttgattatctttcccatgtaaccaaaatcctggaacgggtaaaaaatacccagtgggaggccatggatgcctgcgcgcagaaaatggcggatgcgattgcggataagcattccgttttcgccttcggcgcatcccacgcagggatcctggcccaggagctgttttaccgtaccggcggcctggcggtcttaaacgccatcctgccgtcggaattcatgctcaatacccgccccgtaacgcagaccagctccatggagaagctggacggctatccatccgtcatcctgaagcacacccccatccatgagggcgatgtccttttgcttcattcggtgtcaggacgcaacaccgccgccattgaaatggctttggaggcccggaaaatgggcgtcaccactgtcgccatcacgaacatggagtataccagcggcgtcaccagccgccacaaaagcgggaaaaagcttcatgaggtctgtgacattgtcatcgataactgcggcgattttgaggattccagcatgcttcttcccggaatgaagcagaaaataggccccacctccagcgccgtcggctgcaccatcgtcaatatgatcgtgatccgtaccgtggagcatctcatggaaaagggaatcgaaccgcccattttccacagcgccaacgtggacggaggcgaagaattcaacaatgtcctctttgaaaagtacaaggatcagatccactatatgtaatccttctgtaagtctcaaaagaaaaaggagctccgtcaggaagctcctttttctttcatgatcgtatgcagcgtttccaccagcgcctccacctggaacggctttgccagatgggcattcatcccgctttccagggattttttcatatcttcctcaaaagcgttggcactcatggccacgatgggaaccgttcttgcatccggcctgttcagcgcccgtatcagcctggtggcttccaggccgtccatcaccggcatacggatgtccatcaggatcaagtcataataatcctcttcgctttcccggaacgtatccacggcttcctggccgtttaccacggaatctaccaggcatttctgcatctccagaaccgtctgggcgatttccagattcagctcattatcctcaaccagaagcacacgctttccttccagctttgtcttttcttccttcgtctctccatttgcccggttttccggcatggtgcccttctcctgccgcagtgaaaagtaaaattcacttccttctccctcttcgctgtccagttcgatcagaccgcccatcatccgaaccagacgctcactgatggcaagtcccagccctgttccgccgtattggcgggaggtattgtcatccgcctgttcaaaggaacggaaaatacgctgcttatcctctccgctcacaccgattccggtatccttaacggaaaataacgtatttatgccgcctcccggcaagggcttctgaagcattttcagagtgacgcagcctccctccggagtaaacttcaccgcattgccgagaaggttgattaatacctggttcaggcggaggctgtctcccctgacccattcctcgggtatatcaagctcctgcttaaaggaaatcccctttgcctgtgcctgcggctctatcagattggcaataccatccgccagctccttcatgctgaaggaaccgatctccagtttcattttaccgctctctattttagacatatccaggatatcgttgatcaggctcagcagatactgggaggatcggtcgatcttcttaaggcagtcctccactttatccggctcttccttttccctcatggcaatccctgtcataccgatgattgcattcataggcgtacggatttcatgggacatgcgggaaaggaaatcactcttggcccggcttgccaaatcgtatttttcccggttgatattgctctctataatcttggatatttccacaaactctctgcttatctcttcccggaaggtgctcttttcctccgtcgtcccgtaaacaatacagcccgcatattcgccgttatcatacatgggtaccacaaaacagccggctccggccggaagcatataaaattctcccgccctgtcgttctgctcttcgctgcccactatccggtacccttcattcaggcccgccgcataccgttcgtactcctctgcgttaaaataatgcactcttccttctatccggctttccgggttggtatgccattgatattccggatgtaccgtatgatattcaggctccgccctggaaatcacaatatcagataacccataatgagttcccagcttcaccagcagtacggacaggatacccgccacgtcattgctcttgtcaaaaaagttgaacaccaaaggcaccatggggatgcccctctgataagtgacgctgacaatttcatcaatttcaggcttccggcgcgcacgctccagctgttcacgggataaatcctcataaaaggcagttgccccgtcccgggttattttcgcatatgccagcgcccattccgcccggtcaagaaggtctgcaaagctctctccttcctttatttcagccacaccggaggagagctggagacagaattccgaatccgggaaaagccttgccaggccgtcccgcagttccctcagaaaatcctccgcatctgtacggcccccgttttccagccatatcaggatttcatctccgccctcccgcaccgccagcggaaccagacggccttccccgatcagccgatgcttcatatccataaccatggcgcctatctgctccagaatggcgtccccgaatacgataccgtatttttcatccaggtcccggaatttatccatatccaaaagcagcagggaacctgtatttccttcctctatctgcgccgtgatcagcttttctccgatattgcgcttatacagcccggtaaccggatcccttctcaccgtatccagctccatcagctcccggattttcttttcatggatattctttatgcttccgataattttggaacgttcccggttagagtcgtagatgacctttcctgtcatttccacccaggaatagcctttatcctgttcgcccagcctggcctgaaacaccaggttgatttccccctgccctttcagcgcctcgcgcaccagctccctgtcatcctcatggacaacctccttctccatacggagcaggtcttccctggtgtaatggcattctatcgtgctttccccgttatccccctcttcctttccgtccacattatacacatccagggagccctggcgcacatcgtaggcataaaggatatccgtactgctctgcagggcgatacggtagcgttccttttcctccatcaggctgtactcggcttcctgctgtttattcgtcagctcacgcaccacctcatagagttcatccacctcggtgatatcgctcatctgatagccggaaagcttattttccctgctgtctctgatgcattccacaagccttcggataggcttcgtaagattggagacaatcacataaatggccacaacgccgaatcccagccccaccagaatggcgattaacagattccatataattttatccccgatgccgaacagcgtatcctttccttcgatacccgccaccacccaggtttcttccgcaaaaggtgtattggtattgtacagatgcagcctgctgatattggcataggcatccttcccccggaccttgatgccgtacagggaatcatagcgggtcttctccgcagtcagggcttcctcctccagcgcggccgttcccgtcactacaagagggagaagagtcccatcctccgtatatttggccagcatgtagcttccctggttcttgctgctcagttcccgcaccggcagcagctccgccatatacttcgtcgaaatttccacgcccatgactccgtaaaccgttccctcataaatcaggggcacggaataggtaatcatgcggtagctgtcgctgcgggaatttccttccatgacgaaaggctcactccaataagccagattcgtgaatttcgtatccggataaagctttgccgcttcgtagggcttgtaaaagaaattatcccacgcctcagcgccgctttccccgaaatgaaaatccgtggtccagagggtatcaaagggaatccctttttcatgggaaaaactgctgcttcctctttcaaggaggatatcggaataatccggaggtgtcccctccggatccgaatcgcggaaataaattccctggcagacagtatcgtcccctcccacctggtcattggcaagaataaggaacgagcctgtcaccgtatttttacgcatcacagacagacaggtgtcaaccatagcctgtaaaaattccttctgcatgctgttgctgcgcagaaacttttccggtgtccgctccctgttctgaacaatcctttccatggtgctgttggctacgcttacctcttcctccagatccgaccagcgctggaccatgttgttttccagaagaattcttctgttttccaccgtctggttcagaatccccacggaatattcttttagaagaaaaggcgtcccgctgaaaaaaaacgttccatatgaaatcatggactgcaccaccatgacaagaatcaggggcacaataaacaatttaaaaatcgtttttttcttgattgtcatttactctctaccgcttcctgcagcttcctctcaaagccggtaaaccattgatcaaaagcttcctctgaaataaactctgctgctgcttcctccagactcattcccgcattcaggctctctaccacagccgccctgtctgctgccgctttatcggaaaggtcatattccagaacctttcttgccgcggctccgccctggaaggctttatttgtatacatgatactgctgtttaccgtatcaaaagctgcgatcagggtatcaaaggtcttgggcacaacatccagatccttttcctgaatcaccttatccagcacctcttttgagttggcgtctttcttcacaggcagataaccggaagcacagccaaacacaagattgttttccgactgggtaaaccacttgaggaattcggtgcaggcatattccctctgcctgtcggaggcggtcaccaccatacccgcgccctgctgtaccgcataggcctctccgccttcaaataccgccgcgggaaggatgatataatctatgggataggtttcatcctccagctccacctcatccgggaagtacatggcagaggtggtggaacccgtataagagatgatttcccctattttcacatcatcggaacggaacctgccgtatgagctgaaatatccctttacataaggcacataccaggtatcccatatccgcttcatcacatccctgtctacctgaagagtaacctgctgatccttaaccttgaaaatctcagtccccagctgcatggaacctataataaacaaattcgccatggcatccctgccgtaaaaagcctttccgtcgttttctaccgcaggagtcagactgtccgtccattcataatattcctttgccgtttcagccagcccctccatagtggaaagagaagacagctccgcgcctgtggcagcggcaaatttatcccagtccgtcttatccagcattaaaatctcactggatttggccgtagggaaaataaaaagctggtttccttttcctatccgtccttcctccacataggaatccacatattcacttatttcatcctcagtcaaataggaagaaagatccgccagatagcccatctgctgaatctcataagcggtatccgcatagctggaaaaaatgtcgggggcctcatcgctgcccacttccttcttcagggctgacctcaccgattcctccagctggttcacatcccctttgccggtgctcttgacaaaaattccttccttcattcccaccgtatcgttaaattccttcaccagggaatcgaaggccgtctgctgggccccgttataataatgccagattgtaatggtaaccgggttatccggatccagcttcaccttattcttagagccgcagccgccaagcagcatcgcagccgcaacagcagccacacaaaccagaacccaaaacctcttctttttccctgaaagatttttcatagccaccttttcctccaaaccctgatttagttaccttatcctagcattatacatgattcagaaacagtttgcatccttttcacatctatttttccggcaaaaaagatgatatactgatctttacatactttttacatacaattgccccgccgggcagaaaggaactgccatgaaaaacaggaaaaaaacagccccgccggctctggaatgcacccgctggagcggcgttttggaagaaaataatgtctggaaggaatatccccgccccgccatggtaagggactcctattggaacctgaacgggacctgggactaccgcatctcaaccgattccggcattccgccggcatacgacggcacaatcctcgtccctttttccccggaaagcccgctgtcaggcgtaaagcgccagcttcttccgggagaatacctctggtaccggcggcgccttaccctccccggtgaccggaagggaaaaagggtgatcctccacttcggagccgtggatcaggaatgcgtcgtttacctgaacggcagggaggccggctcccatgccggaggctacctccctttttctctggatatcacagagtacgccggtgacgacaacgagcttctcgtccgggtacaagatttcagcgacagctcctatttcagccgcgggaaacaaaagctggaaaaaggcggcatgttttataccgcccaaagcggaatctggcagaccgtatggctggagctggtacctgaaaaccatattgtctccgtgcgttttaccccggattatgacgctgcctgctgccatatcctggtgaaggcctcaggctcctccaccgcccggatccggtgcggtatacgcccggaaaccgaagaagatgcgcggcggcgcgacgatccctcgcttcccgcggcttcctgcgtaccttccgatacgttcttcctgactcccgggaaagaatatacccttcctcttccggatttcactgcctggactcctgagaatccttttttatatcatgcggatctggatctggaggaggatcatgtggaatgttattttgccatgcgcaaatgtgatatccggaccgacgccgcaggcctgcgccggatcttcttaaacaatgccccctatatgcagacaggcgtgctggatcagggctactggcccgacgggctttataccgctccctgcgacgaagcctttcttttcgatatccgttccatgaaggagctgggcttcaacatgataagaaagcatataaaaatagagccgcagcgctggtattaccactgcgacaggctgggtatgctcgtatggcaggacatggtatgcggaggcacctcttaccgccactggttcgtcacttatatggccactcttttcaacgcccttcactggtccgtgaatgatgggaaacagagccgatcccttctttcccgaagagaagaggaagggcagaagctgttttacaaagaaacccgggacacgatagaagcgctttataaccatccctccattatctgctgggtgccctttaacgagggctggggacagtttgacgcccttaaggccgctgatttcattcgcgttctggatccgggccggctcatcgatcacgccagcggctggtttgatcaaaagggaggcgacctttgcagcctgcattactatttcttttccctgaaattcacgccggaaccggtccgcgccctggctctcaccgaattcggcggctattcctggaaaatcccgggccacagctacagtgacaagctgtatggctacggcaaatatgacagcaggcaggcgcttacggagggctatcgcaagctcctcacctcaaccatcctccccgccgtggaaaaggggatttccgccacaatctacacacagctttccgatgtggaggaagaggtgaacgggctttatacctatgaccgtgaaattctgaagccggataaggaaaccgtgatccaattaaaccgggccatgaaggatatcgtaaaccggacaggcactgtgtaacaaaaaaccggagccttttaccctggtgatgccgccaggcaaggctccggttttttccgtccgttttacttccgctctgctgtgtcaggctcgctttccttccacattttacggaacacgggaatatacatgatcaggctgaagagcatgaatgcggcgcagatgaggatgaggctgttggccgctgcggcaccgattcccggaaacagaagaaggacgaacagcaggacatacaggacagccgtacataccttgccgaaccatttcgccccgtccagcttcttccctctgggaagcaggagcaggcccataatccccataaagccttcttttacgataaacaggacgagaactgcgcgcatcagcggataacggatggcaaagcagatcaccagggccccctgggtaagcttatccgccaggggatcgatgaatttccccaactccgttatcatgttgaatttcctcgccaccttaccgtcaaacatatcggtaagccccgatattcccacgagcacggccgccgtataataatccgatacactgtcagcctgcacataaatccaggtaaaaaccgggatcagaagaatcctgaaataccccataagattggggatggagaaaatttccttagctgttatttttctttttgtcattttacccccttgtccgctatcggggaaaccgtttcctttcccgcccataataatgggccggaagccaatagctgttagttccattataccttttgtcttttttatccgcaattgatccctgaaaaatgaataaaaaattaagaagctgagattcttatttcctatattgacttgttccttcccctgtgctattctatacaaaatttcatatgacttcaaaggcagtgacaagaaacagtacgtattttggattttacagagagaaggcggcaggtgcgagcctttattgaaaaaataccgaacccctcttcgagccgtgagccgaaccgtttttacgcagtaagcatcaccgggttctcccgtaacagagaaaggtatcgggatttatcccctgtaccgtgagcgcggaatttttccgaatttaggtggtaccacggacctgaccggttcgccctaagccaatcccttttacccgggacggctcagggctttttttatttccccgaacagctgcccagggacaggattaatcctcccctggcagccgaagctgtccctcccatccagcaaaggaggttatttatcatgaaacttgccaacctgatcggggagcgctttaaagagactccctccgactgtatcatcgaaagccacgcgctcatgctgcggggcggctatatgaagtatgtggcaaacggaatttattcttccctgcccccgcttcggcggattaccaaaaagatcgagcagattatccgggaggaaatggatgccctggacgggcaggaggtacagttcccggtagtcctcccggcctccctctggcaggaatcgggacggtacgaatccgtgggcagcgagctgctgcgcctgaaggaccgaaatggttccccgctggtgctgggaatgacgcacgaggaagcggccgtgcagcttgtcagggattatggctccacctacagccgttatccctttatgatttaccagatccagaccaaattccgggatgaagcccgcccgcgcgccggccttatccgggtgcgcgagttcaccatgaaggatgcttattccttccatacctccacggaggatctggaagcttattatcttcgctgccatcgtgcctatgaacggatttttgccagggcaggcattccggaggttctgtccgtagcctcggattccggcatgatgggaggcagcctttcccatgaattcatgcttctcacacccgccggcgaggattccattgtcctctgttcttcctgcggctaccgggctaacatggaggcggtggagtgtattacgcaaaactgcccggatgctgaacctgcgcccctcacaccgatcgaaacaccggatatccacaccatcgaagagctctgcagctttctgggaattaacgccgcggggacctgtaaggcggtcgtttatcagaaaaaccgggatgactcctatgtcgtgctctttctccgcggggatctggatgtgaatgaaaccaaactcaccaattaccttggggaagaggtccatccggccctgattcatgaagacagcggcctgcagacaggctttatcggcccctgcggactggacggcagctttaccgtgttattcgaccgttctctggagggcgccctcaatctcacctgcggcgccaacagagaaggcttccattataccggcctgtgtatgcagcgtgactgcccggacgccttgtatcatgattttgcaaaggccgtggaaggcggcatctgccccgtctgcgggaagcataccctgaccatatccagggggattgaggtggggaatatcttccagctgggcagcaaatatacccgtgccatgcatatgcagtataccgacgcggagggtgtgtcacactatccggttatgggctgctacggcattggcgtgggacgtctggcggcctccgtctgtgaagcccgtcatgacggcagcggcccgatatggcccgtcaccatcgccccctggcaggtccatctgtgctgcatgcgcagcgataaccgggaagtccgcgaagccgcggataagctgtatgacggactgctgaaagccggcatagaagtcctgtatgacgacaggaacgtgagcgcaggcattatgttctctgacgccgatctgctggggattcccgtccgtctcatcatgagcccccggaacctgaaggaaaactgtgtggaaatgaccctgcgccgggacaaaaccgatacgggcaggtattccatggaggaaatcattccccgggtaaaggaaaaaataaacgaattaatggcggaactccagcccgaaagctgaagtccgccatccgtaccccttatctataggaggttttcaatgcctgccccagtattctgggatccttgttgtaaggagtaaccgggcagatccttttattggtgattcccaacagggaatatacggcgattctggccgccctgacggaatattcctcggtaaataccatatcctccggaatttccacgaactggcttatcatggcaaagtttgtggaaccttccggaaccaccttcggcctgtcgctcattttcctcggctggaactgggaatctatatagggcatcatacaggggatcacgttgaccacgctttccatgatttcttccatatcgtcctcaaaatgaaggtgatgcagaagctccgtaaacatttccctgccggtgcattcccgcatgggcttcttcacataatctcccagattattggtatacagcccgtatccccagaaaatagtctcatcctccgcctgggccttgaaatggggctgggccgccactacaatactcatcctccatccggaatccttaaaggtcatcagcgcgccgctgccgggtatattcccggagaatttttctatcatctttaggagcttattccccttcatggtaacggtaaagctttcccagttcgtttcctccggtttatcaaagaagggcgccggatttcccaggccgggccttttagcagccacttttttccagagttcacccgacatgggggcttccggacagaaccgggcaggcgtatccatatcgcccaaagccgcgttgtcggtcatgcagccattagtcatgatacagagatcgccatccttcagcgtgatgatttcttcttccccgtccctgtccagatggattgcggccgccgtgattttttctccatccttaaaatcaatgtctgttaccgtcgcacggatgctgaaatcaaccccatggctttccagccatttctgaatggggagaatcacggactcatactggttataaggcgtcctcgtcacaccctccagtgtttcgattcttgaaaattcaaaaatcatacggttcatataacgtttgaactcaaacaggctggaccaggtctggaaggcaaaggtggtctgccacatataccagaaattggtttcaaagaaatgcggggtatccttaaaccactccgctatggtcatatcatccagcttttcctccggcgtggcaagaagctttccgagagccattctgtccgcattattaaatcccatggaatgcacatccaggatatttccctccttatcgatcagccttgcctgggcatgggtgggatggagatggtcaaaattaaggatttcctccgttacactgtggccttcccagtccagagaagggatgtcagaaaacagctcccagaaattttcataggtttcttcattcagcatcctgccgcccctgcatacaaagccttccgcgggtgtgccggaaccgtcgttgctgccgccgagtatgggcatcccttccaagatatgaatccgctttccttcccatcccgcatctctgatcagataggccgctcccgccagggaaccgaggcctccgcccacaaaatagatatcgttttctccggtcgtcctgttttcatcggcgggtattggcgtattccctttcttcttctctgccgcccgtgcttttccatatgctactgctgccccgattcctgcggccgccattgttaccttaagtaatgtgtggttatttttctttgcgctcataatatttcctttcttttacctgaattggatggcctgtgtcctgaatttctgctttctgcatccgttgtttttcatgtctccagaatactatctccaaaagcttttgtaattaggcagaaatcctgtcctgtctgaaaaatttacatgaggattaagctgtctggttttacgacagtttccggaaaatgtatatatgattcccctgttatattctttacaatagattcagagatcttcctgtgcttatatgggcgcatgcattttctgcatacaataagcgaaagatatgtaatacagtcataaatgtaaaggtaccgaacagttatacactaccttaaataggaggcgtcggaaatgcgtttggataataaactgaaaatagcggccttcgataccgccatgaaaagcctgctgaaaaacaaaaataaatatccggaccgaacggcccggaatatcctggaatcaggtgcggctgttttccaccgcagtatgaatgaggacgagaaaaagaatgcctttcttcatattaaggaaaaacttccggaacgggatgaagatattcttgcctttatccgggatttattcggctccaactaaaaatgcccgcccatgcggcctcctgtagccgcaaggacgggctttaaagaaacagaagggggcaaatcgcagtactgcaattattcttctgtaactttcatcatatactccgcccctccgaatccgggcgtgctgtccagcctgacttcgcatcgtatgccgtccatgaggacaatggccggaacatccttgacctcatactccaggctgatattttccctgtagcaatagtcttcaaactttctgaggaaatcttctttggaggaaggtttttctttcaggctgatacagagggcataacctgaccttccctggttcagcttacgcgccatgcgcgacagataccaatagtcccccacccagatcaccaccagaacaaaaaaactcagcactataatatatcggatccaatcagggatataataagcaatacatatcagcgcaaacataatgataataatgctccacagcgcagccaaaccattaatcatgcgctttttcacggttcccagctgaagaagggctcccaggacaatatagccagccagcatgggaaccagccagggcagcgccgctttccccattgtcttataattgatgctgataaaaataacaacgcacacccatatgatgccgcctaccaggcttccccgtttaatcgattccatataaagttccttattcctgatgtttgtctttgtcatctgaaatacctccttcattcctgttatccagaatcctgtctcttacctctctcagatattttctggatatatataccagttcgccgttttccagcttcacttccataagcccgtttatcagaggacgatatctcttcacccggtccaggttcaaaataacggaacgggatatcctcaaaaaagaggacggaagcattttttccagaacatacagtctctcccttgtttccagtacatctccttccgcatggatcagctgaacctcctgaacggattccacgtaaaaaatttcgctgcttttcaccctgtgtatttccccgcccttccggcatgagagagataccatcctccaactgtccgtttcaatatattctttcagtccggcggagcatacatcctcaccggtcagccgcaggagcgcttcttcctgcttcttttcctccacatgttggatccttaccctcacggctgctcactcccttctttcttacagcatttcttgtttctgatatcagcatacctaattatcagataaaaatccagtcgtttacggtgagtgggcgttacggaaaggtaagtggcaaaaagaggatcgcccctggcgatcctctcagcacttctctgtattaaccttttatttttgaggctcagatgattcattcttcatatccgcgaaacgccgggaagccagcaattcggtggaacgggccagccgcctcagccgctgcgccacctcatccgtctgttccttcatgccgtcggtcacccactgcatgaccacgccgcagatcccataggcataaaaagaaccgatgaatttcttttcctccccgtttaccagcccttcttcatccagaacggctgccgcttcctcgaataaggtggaggtaatgctgtaaagataattgctgaagccctccccggcattctttatcacattgctgtaaaataccttttcctttttcagggtatccagtagctgttttatacgaagatgccagttatcgaaggtaatcccgtccagaatcgggacaaagcattcttcataatagatccagtccaggagctcatacttatcctggaaatgataataaaaggtctgcctgttcaggccgcaggcagccgtaatatcccctattgagattttcaggaatgatttctccgccgccagattcttcaggcactgggctatggctttcttggtaatcagggaatccgacatgtcagtcctcctctttttcgcagatgcgtcctcggttcttttccggctgcaggatcagtataccagaacctcacagccgtcttccgttaccgcgacagtgacctcccactgggcggacggctttccgtcctccgtatagatggtccatccgttggcatcatcaacaaaaatatcaggccctcccaggttcaccatgggttcaatggtaaacaccatgccgggaaccatgagcatttccgtgccttcaggcgccacatagctgacaaagggatcctcgtggaattccagccccacgccgtggcctcccatgtcaatgacaatgctgcatccgttcgccttcgcatggctgttcacagcagcagccatatccccgaggaaggtccagggctttaccgcttcaatccctttttccatgcattccttcgccacgcgcacaagctttttcttctcctcatccgtctctccgatgataaacatcctggaagaatcgctgaaatatcctttatagatggtggaagcatccacattcacaatatccccattctttaaaatatcctcttcaccgggaattccatggcagacctgattgtccacggaggtacatacgcttttgggaaagccgtcatatcccaacggcgcaggaatgccgcccatttctctcgttttgctctccaccagacggtcaatttccgccgtgctcattccctcgcggatattttccgcaacataatccagtaccgcaatattaataaggccgctttccctgattcccgcaatctgttccggagtcttaatcatgctgtgatccgggacgatatgtccctgcagggcgaatgaccttattttctcatcaaaggcctcatggcattgtttatatttcctgccgctgccgcaccagcagggatcgtttcttcctattttttccatttccttttcctctcaggcttctgttaattttctgcttcaattctggccgccagatcttccaggtacatccagcgttccatcttctgttccagaagcgcttccacctcttccttttccttcgtgagctggttcagcttcacaaaatccgttgccgctgatgccgtctccgcttccaggcgttccgccttttcctccagggaagcgatttccgcctcaatggtttcgtagtccctctgttcctggaaggtgaatttcagttttttcccctttacatgctccggctttccttttttccccgtccggtccgcatctgctgcttcctgccccgctgcccctccggctttcccctttgcctctccggattccgccgccatttcttctatgtaccggcgcagggcataatccgtatagccgccctcatactgcttcaggcttccgttttcttcaaaggcaaaaatacgctgcacgatacgatccaggaaataacggtcatgggatacggtgatcacaattccgtcaaagctgtccagatagtcttccaggatggcgagtgttgtcacatccagatcgtttgtcggctcatccaatatcagcacattgggcgcttccatcaaaacccgcagaaggttcagccttcttttttctcctcccgacagcttgccgatcaggccatactgctcttctccgggaaaaagaaaccgttccagcatctgggaagcggatatgcttccttcctttgtctgtacatactccgccgtatcacggatatagtcaatcacccgcttcgtgggatccatggcagctgttttcacatcgatataaggggtgccgcccgtggcaggctccggttccccgctgccgatttcctgggcataatagccgatttttatggtctgccccaccaccacttcacccgaatccggcggcagctgtcccgtaaggattttcatcagggtcgttttcccgcagccgttggggccaatgaatcccactctgtcgtttttcagaaatacataggagaagtcatctatcagctttttctccccgtaggccttgcttatgtgggacagctccaccgtcgtacgccccatccgggaagaaacggatcccatttccaccctgccgtcagccatcggcccctcggcattcttaagctcctcaaaacgctgaatgcgcgccttctgcttcgtggaacgcgccctcgcccctctctgcatccaggccagctcattcctaagaatggtctgcctctttctctcccccgcagcctgcatctcttcccgctccgccttcatggccagatagccctcataattcgcctgataggagtagatattgcctttatcgatttcaatgatccggtttgccacactgtccaggaaataccgatcatgggtaaccattatcagtgcgcccttccatttcttcagataatcctccagccagtccgccatgctgttatccagatggttggtaggctcgtccaatataagaatgtcggcaggcatcagaagggtagctaccagcgccagcctctttttctgccctccggacagttccccgcatttctggccaaaatccgtcactcccagcctggtgagcatactctttgcctggctttccagctcccattccccgtgtccgttctcttcatccgacccacggccgacaggcaggcttttttcattccccttcagcacgctctccagaatggtgtcttccggatcgaaaaccggctgctgggacaggaaacgcaccaccacatggttggcccttgtcacacttccttcatccggctcctccatccccgccgcaatcttcagcagcgtggactttccggtgccgttgattccaataacccctaccttttccccttcctgcaggtaaaaagaggcgttgtcaaacagcttcctttctccataggctttcgttatgttttccactgtgagtatgttcataagggtaaatgtcctttcttaaaaaacttttaattctggctgctgcgctatctttccgttcctctttttgttatattattgctatagccaaaaagagaatcttttgggctgaaggtaaagaagtccgcccgggagggcagaaaggcgtacatatgaaaaaaataattgcagcggcggcggcagccgccatgctcacactgagcgcatgcggcagcagcggcgaaacaattgccatggtgccggctccaacggattctgccgtaaataccataactgtcaacagcagtgaaaaggtaaatgtagtgcccgatattgcggaggtagtctattccgtccagacggaaagccccgatgccgcaggctgccagcagcagaataccgaggacgtaaacaaggttgtggagctgctcaccggcctgggtgtggaagaaggctccatccagaccaccggctattatatgaatccgcgttacagctggagcaatgatacacagacgctcatcggctacgaggccaccacgacactgactgtctccgatctgcttatagacagcctgggagacatcctcacacagtccgtaaatgccggagtcaataatatccagtccatatcctatttatccagcaattacgatgagagctaccaggaggcgctccgtttatccattgaagccgcaaagaccaaggcggaagccatggcccaggccgcaggctgccagctgggcggaataacgcagcttcgggaacagagcaactacagtccggcacgttatacggataatgcccttgctgaaaaaacaagcctgtcggcagcgagagatacgggcagcgtaacgattatgcccggcgagctggaggtagaagccgtaatcaccgttgaatatcaattacttcccaattcttgaacaggaggctgaacgattatgaaaattctgatcatcgacgggcaggggggccgcatgggcggccttcttgctgaaaaaataaagaaagccgctatcccgggggctgaaatctacgccctgggaaccaacagcgccgccacaacagccatgctgaaagccggtgccgattacggcgccaccggagaaaatccggtgctggttaactgccgggatgccgattatatcataggcccgctgggaatcatggccgccgacgcccttttgggggaagtcactcctgccatggcaacagccgtaggccagagccgcgccatgaagatactccttcccgttaacaaatgcagccagcatgtagtcggtgtgaccgattattccatgtcggagctgacagaacaggcgctttcctatctgctctcctgtattcaagggaccgattaacgacagaaaggaaccgatccttcggaaatttcatccttcgtaacagggcagcggcccctgacggatatcatcctgcgtcggggccgctgctaatatgagtctgcctggcgtacgctgccgccgtccgatgcttacttccggacagaaacagtaccgcacacccgcttatctaattcacaattcttcttacagacaaaatcggtttataggtggcatatccatacttgatacctgttttcacactgctcgcatggacaattctcccatttcccagatagatagccacatggcccgcatagcaaatcagatcacccggctgagcctcctcataggaaacctccctgcccgcgcttctctgggatgacgagtttctgggaaggctgtaaccatataccctgtaaacagactgggtgaacccggaacagtccgccccgtttgtcaggctggttcctcccggtacatagggattccccacaaactggcaggcatactgggcgatatcacttccggtgccgcttcccatcttgggcggcaccgttttggagcctcctgcagatggcggggcagtgcctgagctgctttgggaggaagagttgtttttctgctccgccgcctttctcttcgcttcctcttccgcctttttagcctgttccgcggaggcaagcttctggatctccgcattctgctgctttatcctggctttataggcggctgcctcctgctttgccttcgccagctgtacatcataatccgcagcaatcgccttctgttcatccagggattcctgcagggacgctttttcctgctccagctcatattcggcggcctgcagttcggatttctgttcctccagactctccttcaatgccgccacctgtttcaccgtcgcggcataatcatccagcatgtttctgtcgtaggtatagatttcctgcacatattccgctttatttaacatatccgaccagctcttagcagccatcaaaagctcaatatagctggtctcccctttttcatacagatattggatcctttttttcatggcacgatactgggcatcttctttttctttggctgcatcataatccttctgcgcctgcttaatctgctcctccgtatccgcgatctcgtcctccagcaggctgacactggccatgatttccgcaatctggctggtcaggccgctgatctgggcctctacatcctctttttccccggaaaggtcattgatctgatcattcagggaatccagctgtccctgggttcccttcttctcattttccttttcctgccgctgcttctgaagatcgctgacactggtagcatatgctgtatgcgtcgtggataatgccaatattaatatcaaaatcagactggtaaatttcttccgcatattctgcccttcttacgtatcccatgtgccttttctctgtcaggtataattataattcgcagttcttcactgtcctggggaacggaatgacgtctctgatattccccattccggtcaggtacataacgcatctttcaaatccaagaccgaaaccggcatggcgcgcagagccgtagcgtctcagatccagataaaattcataatcctctttgttaaggttcatttcctccatgcgcttctccagcagatccagcttgtcctctctctggcttccgccgatgatctcaccgattccgggaaccagacagtccatggcagccactgttttgccgtcctcattaagcttcatgtaaaaggccttgatttccttgggataatcggtaacaaaaacaggacgcttgaattccttctccgtcagataacgctcatgctccgtctgcagatcgcttccccaatgcaccttatattcaaattcatcattgtgtttttccaggatttcaatagcctcggtataggtcacatgcccgaattcggaagaaagcacatgttcaagacgttcaatcagccccttgtccacaaactggttaaagaaagccatttcctccggcgcattatcaagcacatagcggattacatatttcagcattccctccgccagcatcatatcgtccttcagatccgcaaaggccatctccggctcgatcatccagaactccgcagcatggcgggtggtattggaattttccgcgcggaaggtcggcccgaaggtgtaaacgttgcggaatgcaaaagcataggtttccgcatccagctgcccgcttaccgtaagattggtaggcttgcagaaaaagtcctggctgtaatccacctttccctcttctgttttgggcacgttttccagatccagagtagtcacctggaacatttctccggctccttcacagtcgcttcccgtgatcaggggtgtatgcacataaacaaaatttctttcctggaaatatttatgaatcgcatacgctgccagggaacggacacggaaaacagcctggaacgtattcgtcctgggacgcagatgtgaaatcgtgcgaaggtactcaaagctgtgacgctttttctgcaggggataatccgccggggaaggcccttctacaagaacttcctctgcatgcatttctatcggctgcttcgctccgggtgtttccacaattttgccggtcaccacaaccgctgctcccacaccgattttggcaatatccccgaagttttccatttcactgccataaacaatctggagcggctcaaaaaaggttccgtcattcaccacaaggaatccgaaatttttcgaatccctgttgcttctgacccatccgcccactgtaacttttttgtccttatactgttctttttctctgaataaatccttaatatttgtcagttccatctttgctcccgttcgcggcttcggccgctgttaaaattattctgtttctgtctgtgtttcagaagccgtttctccggctgccgccgtttcggtttctgtctccgctgtctgagttgtttcctcagaagcggtttcttccggctgtgtatcggtaacagatgcgttatcgaagaggaatgtgagaaccttttccgtcatcatatattccttatagcccttcagatccagagcctttttgtattcctccacatcgtcatagccataatcgcccgcattctttgcaagctccgcgtctacctcttcatccgtcacgttcagattttccgcatcggcaatggccttcatggcaataatttctttggatgcctgctctgcggattcctgaagctgttcctcagaggaacctgtggctgccatgaagctttccagatcatagccatacatagcggcataagacgacatatttgctttgattctgtcataatacctctttaccatttcagccggcggctctttgaattcggaaccttccactatcttggcaagaacatccatctgcacgttggaatcgtgagtactctgctcatcttccataagcaaatcataagcatactgtctgtattcttccactgtgctgcagtttccttccaggccctttaccaattcatcggtaagttccggaatggtttccgtatgaatgctgtttacagttaccgtaaacaccgcatccttgcctgccacatccgcaccgggatagctttccgggaaggtcaccttcacatcccttgtctccccgatttcagcaccgatcaggccgtcttcaaagcccgggataaagctgcctgaaccgatttccaggtcatacccctgagcggtaccgccgtcaaatgccacgccgtcaatttttccttcataatcaatattggcaaagtcgccgttctgtactgccctgtccgtaatatccgtcgttaccatattactctgcagaacgtaatcaatataactctgcagatattcatcggatacctcaggagcggttgctgtaacttcaatccctttatactctcccagagtcacataatctgccacattgattccgtcaacataagcatcatcgccatattccacggtttccgtaccattttccgcctgggttccggtttccgtgctgttctcagtgccggcctgggtgctttccccattatcagccttcttgccgcagccggcaagtacagatgctgacagagccagtactgcaatcgttgctataaattttctcatgatttgtctcctcttatctttaacaatagtgcaacctgcaccgtctgtcattgtaacatatttttttctttcttaaaacccttagttacggtaattcacatatatttaagaaataaaaggactgctttttccttattcttccgccgctttccctccgctgctccagtgtccccgggtacggtgaacgaatacggcggaccgggtacggacagcagggcagcaaaggggaaggctgaacggcaacaaaccaggcgaaattatggtccgtgcccttgcttaatccccgaaagtctgctacaatatttttgcatctaacataaggaggttaccacgtgaatacagttactatagtattattggtcatattggttgtcctgatcgctgcggttgtcgttttatatttcctcggcagaaaagcgcagaagaaacaggccgagcagcaggaacagatcgaagcctacaagcagaccgtatccatgctgattattgacaagaaaaggatgaagctgaaggacgccgggctgcccgccgccgtgatcgaacagactccgaagctgcttcgtggttccaagcttcctatcgttaaagcaaaggttggcccgcaggtcatgacccttgtgtgtgaagagagtatttttgaatctgttccggttaaaaaggaagtaaaggctaccgtgagcggtatctatataaccgccgtaaagggcctgcatggcaccgccatcgtaaagccgaccaagaaaaaaggctggttcaagcgcaatgtggagaagcttcaggaaaaggcaggagccaaaccgctgaagtaaaaagcctgcagttttctgcatatgcaaaataaatctgaataaatggaaacgacggatgccgctttgcgggacatccgttatacaaaacaacagctgccggacagcaaaatatcccggcagctgtttttgtttcttttttctttttgtatctatccttaaatccgctctttactgtatactatatttcctcgtccgccgtccctgcgtcccatctgcggagtaacggccttggctataagggctctctttcccatgaaggagaagggtatgtcatctgtatttcccgccttaatatcctcacagacagcggttacatcctccatgatttccttatggccgttgccgtcgccatgagaaagataaacggtatcaaattttccggcaagctcccccgacagccttttcaggctttcctcatattccgtaattgtcgtggaataatcatcaaacatgaatgtgaaataattacaggcatccccgagaagaacggaacgttcctccggaataagcataaccacggatccaaaagtatgtcccggacagtcatatatttcgatagtggttccgcccaggtcaaaggcatcccctccctttaaatcccggaacgtcccgcagggcgcttcagggataaaatccgccgcagtcacttcctgttccaaaggagttccctccaggccggcttttctgaattccagggaacaatgctcattataaatataatcatccttatgattcatgtacacttcttcaaattccggcgcccccatggcatgatccacatgtccgtgggtgagaagtaccatgacaggcttatccgtaagcttctgcacgcaggccttcaggcttcctattccggttcccgtatccagcagggccgccttttcctttccttccaccagatacatcaattccccgcagaagccgtatattctggtgacccgatccgtcaatttttctgtcttaaattgcagcatgtttcccctcctggtttaaatataccgttttataaattcctctaccatatccagcgcttcttcacagttaaaccctccaaacccgtgattggcccccacaagcttcacaaattccactacctttcccagttccttcattttatgatacagccggcagctttgattgaagggcaccagcatatcgcttcctccatgcatgataagcagcggcggagtctctttttcccggctgagataattcatgggaactgtagcgtcggccagttccggattttccagcacatttttcctgccaatgacaaagccttccggactttccggcccgatatgatcctgtacgctgggataataattcattttggcaatatctgtagggccataccagtccacgatgcagtttaccgcggcagactgctcccggtaggcgtccatatccggcgcatcatctcctgtaaaaccggtcatcagggccgtatgtcctccgctggaatccccccacagagccacatgctgcggatctatcctgtatctggaggcattgattctcagaaagcgtattgccgttttggtatcctgcacctgcgcaggaaaaggcgcaatatcactgggccggtattctacaatggcgatggcatagccccgctggctcatacgcagaagggcaggcagatgacagtacagatcctgcctgtgccaggcggaaccctggacaaacacgataagaggccactgcctgtcaggctcttccatcgttctgggaattaaaacctttagatgcagattgatgccgtcacggttggcatatacctcatccggaagaaattccacatcataaccaaaggtatctttccattttaccgtcttcacgccctccggcaattcctccgattccggaaagctctccggcgggatctgaagcggcggaatcaatttcagttcttccattttgttatcctcctgtcgatttctcttcaatcgctgccttcattgtatcacaaatttgttttagctatgactacttcttttctttttacattaaatttacgcagatgtatccgctcccaaaaaagaaaggcagtctgatttaccggagccatcccctcagcaaatcagctgccttaactatcagatattttccgtccgatcccggctgtttttcagccgctcatccgccggcggacaagagaacctttgcttcttggccggcgcattcatttggatcgtcatatacgggaataaaaaatatatttcccgggccccacctgggtttcgacgccgtcaatgacaatggacgccggggaaggagtggtgatttcataacggaatctgccctcttcctgtttccacagggaacggacaagcccttttcttgtttcaatggaggcttccagccagtccagcctggaatccggcttaggcgctattttcacccgttcaaaaccgggagcctcttccacggtatggattcccgccgcctcttcatacacccagtcagctacggcgccataggcgtaatggttgaaggagttcatatccgtactccagaagtcgccgttttccataatgccgtcccaatgctcccatacggtggtcgcccctttggttaccggatacagccaggaagggtactccgtacgcaaaagcagggtatatgccaaatcggtatgcccatagctgctgagcacgtgcagaagataaggggtgcccacaaagccggtctgcagcctgctgccgcaggaaaccaccatatccgcaagggcatccgccgtctttgcgggatcttcggcaaggttgaaatgcaccgccaggacatgctcggtctgggtacggtaatcggtaaaggttctgcggaaggtttccacaatattccggtataaatcttcatagcagctgacatcctcgcccagcgcttttcccgcctttaccacaagagatgtggaataagcataaaaggcggaagctatgaaatccgcacgggaggatcccttatagcttcccaccggcgcatccagccccagccagtcctcataatgctcgccgccggtccacagatatttatcctttgttgtattggtgataaaaccaatatatttcttcatacagtcaaattgtctggcaagaatctctttatccccgtaggtcagataaatctgccaggggcagatggtcgccgcgtcatcccaggcggcgctgccgcttcccacaaacagagtgggcaccacatgtccgatagatccgtccgggagctgatccgccgccatatcagcaagccatttggtgaaaaatttatccacatcatagttatagcttgccgtcttaacaaaggcctgcgcatcgccggtccagcccatgcgttcgtcacgctgagggcagtcagtgggcacatccaggaaattgcccttctgtccccagataatattgctgaaaagctggttcagcatcggattggaggaacgcagacagccggtccgtttcatatcagaatgtaccgctacggcgtaaaactgctccggcttcggtgtccccgggaactgatcaaggcggatatagcggaagccgaaaaaggtcattttaggcttataagtctgcactccgtcacagcaggtataaaatatcttcgccttggctgcgcgataattggcattatagaaattgccgtccttatccagaatctctccgtgtgaaatttccactttgtctcctgcccttgcgtccagcgtaaactggacatagccggtgacctcctggccaaaatccacaaccgtttccccgttaggagccgtaaacaccgaggcggcctttacatattcctgttcggtaatctcttccccctcctgaggaatcaggttatcctttgtccattcaaatactgccgccggaaaatattcctccgcttcaaaaccggcatcaaaggtttctccgtcatagatctcactgaaacggattttgctttctcctgccttccaactttcatccgtgcctatgcaggttgtattcccttccttatccgtaataacgatttccgcaagaagtcctgccggaatggcggctttttccgcttttccttcctccgtaatccatccgggcacgggacttctgtaccagccctttcctacagtaacggaaagcctgttttcatccttcagaagctgtgtaatatcatatacctggtattgaagccttgatttataggaggtccagccgggagccagaacatactgtcctaccctgctgccattcaggactgcctcatatacccccagtgccgtcacccataattccgctttggcaatctcccttcccccattttctccgccgtcaaattccctgataaatacagggcagacttcccccatctcctgagacggcttaatccattttccactccactccatatgtaatccctctccgtgcgctgcaacgcacctgctgtttatgagtgccggacatgcatattttatccggcctgaaccgccggccgcccaatgactccggccgccgttattccctacaggcttacctgatttttcctgccccggtactgctggggcgtacagccgaagctttccttgaagttcctgtaaaagcagctgatatccgaataaccaaccgcagccgctacctcttcaatgctgcaggtggaattcccgatcatccccgccgcctgcttcatcctgaattctttcagcagaaaccggaacgtcttccccgtctcacgcctgatatatctgctcaaatacccttcactcttcccgaaatgctttgccaggcccgtcagggttaccgtagtgtaattttcccggatataccggacaatcaccggcagtgccgcttcactcacactgatgctgcccatgttttccatctcctgctgatgggccttcagggcccagccgaacaaaagcatcacatagcccttcatcatcaggttgccccccgcttcctgcttatctttctgcggcaggccttccccgcacatctccaggacgattcttcgcagccgctcatccctgccgcagcgcaccaccaatacctggctgctccccttgctgtaaagcatctgccagaaaaaatccgaaatactgtcattttccagcagcaaactgtaaaaggcctccccgaaagtacttctcttaagtattatattgacagtcaccgcatcctcttcccacgtaaaaaccgcctggttcatctcaggaggaacaatcacaaaatctccctcctccaacagacactctctgtcctgcgttttcccctgggcaaaaaaacggcacctgccctttaacgcatacaccactttaatgaacttcaggttatggtaaaacggcggggcataacggtcatgaataataatagaacattccatattttcatcaggaaaacaatcctgctccgtaagaacattccccataaacaccggcgccttctctcccagctcataaccgctggtatccgtcctccggaactgctccttaaaatcttcccagttccacaccacatgacggaaggcctccggattagccaaatatatttcccgacagcttttttcataatccctgagagggatcagtttattctctatttcctgataattcatccgttcctatccctgtgcttatattaacccatattaaataacagtaactgtaactctatttcttataaattctctattttcccgctttccttcatagtatcttctttgtcataaaaagtcactatgattttctgctgtctttttatgacctatttatactaaaagaactgttatgaaagcaggcccttactctcgtttgggagtaagggcctgcctcatcaacctacgctatttaataatcaggacaacaaattgatccccccgttgtccttcggcctgatatacatctcaattttacagtccgccagatattcataattcacttccagggcatagtccacattgaccctgatttccttttcactctctgtaaaggatactttgctggtatccaacccaatcagaatccctccataaggtgtgagataatttgtcatattttttttattttcttcaaataccatatatacatttaccagaccgcgtttggtaaggttcagttcacgctcccggaatttgatgatatttttggtcggttcctcacagccctccataagttcatcgtaaatgacataatgagtaccattttttttataatattgcccccactgtatcgtttcgatttcttcactgtcggcgctctgatcgaactgcagccctttaatggaaaccattacctcttttgtcatagcaaacctcccgttgtcagtattcttcaatttgaatggttttggccgacaggataccatatttaatgatggaattggcaaagcgtttgaatttttccgctccgtcactgacataaaatttatatttgttatcccctaaagccggcgcctggggattgagcagattacagtctgtcagaagctttttcagttcagcggccgtttcgtaggccggattcaccaaagttacctcttcccccataatccttcccacggtggaacggataagcgggtagtgggtacatcccaaaatcaaagtatcaatcccgatatcaataagctcggtcagataccgggaggcaatttcatctgttaccggatcctgaagcaggccttcctccaccagcgggacaaacagcgggcaggctttgccggtcacctttgcatccgggtttatattatgtataaaatcggtataaatctgactgccgatagtcccttcggtacctataacacctatttttccgtttctggtcacttcagccgccaccctggctcccggcttcaccaccccgataataggaatatctatttccttttccaggctgtccagggcataagcgctcgccgtattgcaggcaaccacgatggcctttacatcctgtgtccggagaaaacgtacgatctgcctggaatatctggtcaccgtatcctgtgacttactgccgtaaggcaccctggccgtatcgccgaaatatactattttttcattaggaatctggcgcataatttcccgcgccaccgtaaggccgcctacgccggagtcaaagacccccaccgcagcgccctgcagttctttactctgtatcattccttcctcgattccgccgcagaagcagcatttttaaccgatggaaatctgcctgctaccattccgctcccgcagaatattttacccggttttcatcccggtgatccggagaagcttccttgccgccttcctctcttactccggccgcatccgctttctttcctttttctttatccataaaactgaagcggatcgtaacctctcctcttccggcatccagtatctgataatagtcttttacctgatccgtggattccacaggagttccatcctctattttctgataggcatcgcccgcaaaggtgtattccggatacaatatgttccagaagctgcatacaagcagccctgccgcagcgatatcccttatgatttccttatatttcatgctgtcaattcccttccgtttgatctatggaaagtattgacagacatctgcctgcttatactctggacgttcccttattctgctgaatctggttcagaatggactgctcctggttataaatgtgcattttaatggctttagctcccgcatttttgtccctgctgctgatgcacctgtatatctcttcatgctcctcaatcagcctgccatgctggctcacgtctttaatatattccaggcggtaccggtacatctgctgggaaaggttactcaccatctgcgccagcttttcgttccggcttccctgtacgataatatcatgaagctccacatcagcctgggctatctgtacggcgtcctgggttttggtaatctccgcaaagttatcacaggcctgcctcagcttgccaatctcttcctccgaaattctttcgcaggcaagctccatggcaagcgcatccagcgcctggcgcacttccagcacatccctcaggctcttggccgtaatctgtgcaacctccgcgccgcgcctgggtatcatcgtaaccagtccctccagctccagcttgcggatggcttctctgataggggtccggctcacgcccagtttattggcaagatggatttccatcagcctttcccccggcttcatctcgcccttcaatatgctttcccgcagagtgttgaatacaacatctctcagaggcaggtaatcattcgtattttcttcagctttcatctatgctccattctgcgtgcagggcacgtgcttatttcaactgcgtgcattcatttacggatacaggtcttatcggaaaaagaagtgaggtacacctgtttagccaggccggcccttctcagctcctcacaggcctgtgccgccaggtcgtttctgtcatataaggcgaatacggtggggccgctgccgctcatcagggctcccagggctcccctctgcatgaggaactgcttgatttgtccgataaccggatattccttttccgttaccgtctccagcacattttcaagacgttctgccactccccggatatttccttcccgtatgctgtccaatatcccgtcaatatcagggtgcttttccagtttatccaggtgcaggttttcataaacgaaacgggtggatacatgaatcggcggttttgcaataatgacagagcatcggggcgcggacggcaggggtgtcaatatctcgcctattccttccgacagcgcggtcccgccctggatgcagtagggcacatcggccccgattgccacagccttcttctgcatatcctctatggtcattcccagctcgaaaagctcattcataccggtgaacgcggcggcggcatcggtgcttcctcccgccattcctgcagcaacaggtatttttttcttaagatgaacggacagtccttctttgatgccgtattccttccggagaagctccacggttttcacaataaggttgtgcccgtccgtaggcagagaacgcaggttggtggtcaggcgcaccctgccgccctgctgtttcctgaaggtgagctcatcatacaggtttaccgtctgcatgatcatcctcacttcatgatatccgtcttccctgcgccttatgacatccaggcctaaattaatcttggccattgcttttaatgtaatttcttccatttccggctcctatctgtacatcaggaattttgtccggataaaatggtaactattatgcctgtacctgttctattccggattgtatacactgattgtacttaagtatatacaattcgggcgggttcgtcaatgtttatctttctttgtaacaagcccgaaaagccgcggaaatgctggggaaaatgacatttaacagttcgtcttagtttatgataatttctttcgttttataccggtatcgtacggattgggacaggaataggggcaagcttccccggctgcaggtgttcgggaatactggactgagtattctgataaaaacgactcaacctttcgtcagcattaaggagcatgctccccccggctcatgctccttaatgtttctcttatattcaggaaattccttttacaatcagcagtttatctcccggatggatttcatccgaagtcagttcattaatatccttgatctgcgacacgggaacataatattttttgcctatattccagaggctgtcgccctcccttgcaatataggccacgatacccggcaggctgctcagcttatccggatccagatccgtcactttaacatcctggatcatgggctcttcataatggctgaacacaatgccgtggaaatccagtaccgccttcacttccacctcatccgcatctatcatggtaacgctcagatcctcgggaactgaatccagcttataggtgcactcagggctgattccgggaatctccagcacatagctgaagggaatcgttccggcaatgctgtcatagggcacctccggatccccggtcccatacaggcttttcaccgccgccgcaccggtaatacgcaggccttcgtccacaatcttcgtttccgccatctgtatatcgcactcgctgtggcagagctgctgcattttaggcagtcccgctgccaccttaaagcggccggagatcttggtttttcccatgtttttcatcaaaagcttcttcagctttcctacgccggccaccgcttccatttccctggtaaccccatatatatcagatagaatttccgtctgctcttcttcatatattttcatatccagatccaggacaatttccagccctacaatccgctcttctccatcggtatccgccttgacctccagctccttgtggccgatctggcaggtaatgtcatccaccatacgttcccgcaggccctggcagtccagaacgccgctgaaaggtatcttggcttcataccacatgacaggacggttttcgccctctccctcataaaggaaaaacagctgaacctctccctgtatggaaagcttcccttccgacagccggaactgggtctctcccagcttgcaggtctgccagaaaatatcaaagatattgggataaccattcggcagctccatttcctcacggattcggaaaatatccttcttctggatagccaggctggccaggttaattgtcttctgcctgaattccaccggttcattgctgctcagctccacggcagcttcctcatcataaagctcttccacataaagccccagccggatcagtgcctgcacgctcagctttctggagtttatcatgccgacacttaaatcctccagatcctttttcacggaaacgctgtcggtgggaaccactccctccatataaatctgctcgtcaaaaggaatgcttccttccatgctggcaggcctgcgcacatcatcatccgacagatacaggacacaaaattccagctttcccttgatatacacatgatcctgcaccgctctgatttcatcgatgaccacttctccctgctcctctatgagctggtaaacgtcaggcctggaatccgtgatattgatatcatcttccatcgttatctgcgtactggccttacatttaatgcggtccatatgtatattcttttttattaattccatacgaataccctccacgcgaatgcctttgtacaatgtattcggcggatgggaaaatatgacggctgcatgcaatttttaggtactttcttattttacacaaccgataatttcatgaatatcctgtatcttttcttccttcataaaagcttcgattcccttcaccacttcctcagtggcgtaaggattgatgaagttcgccgcgccgaccgctactcctgtggctccggccatgaggaattccagggcatcctcggcattggatatgcctcccatcccgataatgggtatggaaaccgcctgggcgcactggtaaaccatacgcagggctatcggcttgatcgcagggccggacatgcctcctgttttatttgccagcacaaagctcctgcggcggatatcaatttttgtccccaggagggtgttaatcagggaaatggcatccgctcccgccgcttccgccgcttttgccatctctgtaatatccgttacattagggctcagcttcattataataggctgtctcgctttttccttaacagccgccgtaatctcggaaaggcactccgctttctgtccgagagcaatgcccccttccttcacattggggcaggaaacattgatttccagcatatccacatccgtgtcggccaggcgttccaccacttccagatattcttcgattgtttttccgcatacgttgacaatgatcctggtatcgtacttctttaaaaaaggaatatccctttcgataaacacatcgatccccggattctgcagcccgatggaattaagcatgccgccgtatacctccgccactcttggcgtgggattccccggccagggaatattggcaacacccttggtcacgacagctcccaattggttcaaatccacaaattccccatactccatgccggagccgaaggttccggaggcagtcatcacagggtttttaaattctacgccggctatggtaacttttgtattcatatttccacctccctggcctcaaatacggggccgtccgtgcagatacgggcattgttcacatgcgaatgggcgtccacgtcctttgtcctgcagacacatcccaggcaggctcccacaccgcaggccattcgttcctccagggaaatataggcgggaatatcctcttccagggcatactgcttgatcgcccggagcatgggcatagggccgcaggcgtaaatcacatccgctttcaatccgttttcacggatggcatccatcacatttcccctggtgcccacactgccgtcctccgttgcaataaagacctgcccgtttttttcaaaatccgattggaggaaacagttttcatctctgtaccccacgatgatcttcttttcacagttcagctgtctggccagctccaggatagggggaacaccgatgccgcctcccatcaggaacgccgtctgcccttcatttgccttgtccagagggaatccatttcccaggacgcccaggacagcaatctcgtccccttccctgtaagcggaaaattcgccggttcctttccctgcaacccggtacacaaggcgcaggcttccttcttccttattcacctcacaaatactgatgggacggggaagcagcgtgcttttatccttgggataaagggcaacgaactgtcccggagccgcatcctgcgctaaactggtctttatccgacagtcataaataccgggggcaatctcctgctgccataaaacagtggcttgttctttcttcttctgtgccattttctttcctttccgcttttacacttgaatattctattctcagtctcctggccttccgtccggaatcagatacgataaacgatctttcctgcgcagatggtataatgaatccttcccttcatttcccatcccaggaacggcgtattggaggatttggagtgaaaatgctccgccttccacagctccttctcatcaaaaaggatgagatccgcagggcctccttctgccagatatccggcatccagatgataaagcctggcgggcgccagggacatccgttccagcagctgaagcaaagtcagctttcctgtgtccaccagattcatgatccctaaggaaagggaggtttccagtccgataattccgctgggcgcctcggtcagaggcttctctttttctctcgccgtatgaggggcatggtctgtggctatcatatcgatggtattatcctgaagcccttcaataatcgcctgtctgtccgcttcctctctgagaggaggattcattttagcaaggcttccgtattgaatgaccgcatcctctgtcagtgtgaaatgatggggtgtcgcctccgcatggacatccgccccccgccttttcgcttccctgactaaagccaccccttccttggtgctgatatgctgtatcaccaccgcagctccggtctcctccgccagacgcacatccctctcaatcatatcaatttccgcctgccggccggaacccccgatcccaaaatggccgctggcttttcccctgttaatcccgttattttctatgaaggcaggattttcttcatgaaaactgatgggaactcccagcactgccgccgttttcatcgcattccgggctgtttcttcctttaataaggggataccgtcatccgtaaagcccacggctcctgccgccgcaaggccttccatatcggtcagcttttcccctttcatacccatggttacattggcacaggtttccacatgaatcggcgtatgacggcccttttccagaacataatccagggtttcccggttatccacacagggccttgtgttggccatgaggaccaccgttgtcatccctcctgccgctgccgccccggcgccggtgtcaatgtcttccttttccgtaaaaccgggatcccggaaatgcacatgggcatccaccagaccgggagcggcaatcatgccctccgcgtttatgatcttaagcatgtcctccttttccccggaaaaaacagcagcctctgtttccgggatagagtctgctatttttataattttttcatcctgtatcaggatatccttataggcatccgtacctgacgcagggtccgtcatgtgtgtatttttaattaacagcatgctgctctcctttattcgttggtatttctattgtatcaaatcccgtttttttcatcaacttgtttcctgctattgttctctgtaaaaacggatgccggtgggcagcccggccgcttctcttcaatcaaaaacgactgttttttcccggaattcaatttttaatacaatataaggataagaagggctggtggcgggtgtacttcctgccttcggccccagcaggttggtatttacataaatagcattctccgtctcatacagatcattcactgtaacactgtaaccgccgctttcctgttttccgtacccgatacagatatacagatatccctcatccgcataggtaagcttgaaggcactttcctttttctgatccaggatttccttcagctcatccgacagcctatcctcactcaccactgtgaattccagattttcccggctttgttcttctgccgtatcttttccgcaggcagtaaagcagacggccatgatagaggctatcaccagcaagcatatttttttcataaataacctatccgtcttttttactaatctattgacgtacaggatgtcctatgcctgttttttccaaagaattgccgggtaccggcaaaaagactgccgttcttcccatatggaagaaaaggcagtctttccacaatcatcgttctttttttatgtgttatccacaatttttctcgccacatccggtttatttgtgattatggcatcgattccttctttcacaagaagcttcatatatttttcatcatccacggtccatacatgcagaagaagatttttttcccggcatgcctcaagaaaaccgtcgtactgcaggttatacagcgccggatggagggcgtccgcgcccagtccggcagcatagcccggcacatcctggaagccgtcggcatatagcaggcctgttctggccgccggatcatattcccgcattttcataacgctgtaatgattaaaggaagaataaatgattttcccctgcattcctttttccttctccagcagatacagcttttcctcaataccggggtaaaaataaattcctgttttgatttccacattgatctccagccccagaggcttcaggagatcatagacctctcccagcgtaggaatgcgggcgtccgcatattccgggtgggttttgttaaacacaaatttcttaagctcctccagcgtataatccctcacatagccgtgcccgtcgctcacacggtctatcgtttcatcatggattaccaccagctggccatccttactcagctgtacgtccagctccacgccgtccgccccctgctccgctcccatacggaaggcctccagtgtattttccggcgcatatgcgctggctcccctgtgtgcccatacttttgatttcatagggtctctcctcctatatttccagtttcattccgtcatatgccgcaatcatgtttccatactcttcctccggactgtgaagctccctcgccatatgggaaagcaccactcttccgtcctctttcaggatctcgcattcctctatggaggccacaagaagctccaccatgggaagggtgttatggctggctatccgataattggcccgcatattccccaccgtcgcttccagaatcatcacatccagcttctgtttctgcaggacggaccaggtttgggcaagaaaccatgcgccgtcgcagccgtaaaaaaaggatttaccctctccggaaaaaatataatgcagggccgtctcctgcgtcctggacacctcatgattggctccgagaggcagaatcgtcatatcccccgctttcaccctttttccgatcttaagcgggtgtatgttcatcctctcctgctcctcctgcgtcagtttaagccagggaatggtgccttcatggcaataaaagcccaccttccccttcgcttctcccagaaagctgtccagcgccttattggtgaaatgatccttgtggctgtgggtcaggaaaattcctttcagccccgacaaatccagcttaagcacctttttggcaaaaaaccaggactccggcgcgggatcgattagatactttccattgatcaacaggctggaggtacggcggatcacgccgttcacatcatatcttacatccgcccccggccgcagcggccagtccgcagcccccgttcccagaaaaacaagttcaaatgccgccataatccttttcctcctaattccggcttttctgatattccctcggggtcatcccgtatttctttttaaagaggctgaaaaaataggggtagctggtaaagcccgactgatcaatgatttccttcagctttctgtccgaagtatccataaactccttggcacgttccagcctcacttcgttcagatactccacaaaaccggtacccacctcggacttgaacagggtgctcagataagagctgttcatacccgcattttccgccgcatctgacagggatatcccttctctgtaatgttgatggatataggatatcactttcttcaccggaacggaatagtctttctcatattccggcttcctgttttccatgaggacagcctcaaagaggtgaaggaaaaatccacggcattccttcagcttttccagctgcgccacgtattccatgatcccggtccggtgcccatataccttttcataggctatcccctgttttttgcaaaaagaaagggaaaggatgagtaaatcggaaaaaagctggctgcagccggccctccctatgtttttttcatagatttcccgaaaaatgccttccagcacttccttcagttcttccgcgtctccctgcttcagagccgctgttatcctttgctcctcttccagacggataccgctgccttcattgtattctcttccttcttccatttcccccggtttgtccaaatccaggaattcatttcttctccggttttccagctcctggaatccggtctgcatttctgtcagagggccggatcttcccacatggaaatttccgtccagacgcatgaatttattcaggcagaagctgctgcggttgattattctgcgcagctcctctcccgccttctgttcactgacaacaccattcagcgaaaggagcatcagaatctcattgttttccaaaggcacggccagtccctggaattcttcccggataatctcctccagcacattacatacggaaaagataatcagtcttttatcccggagtgtccctccctctgctcccgcggcggagtaaatgaccttttcttccagattccttatactcagcagtatgggtaccacacgcccggcgtccagctcaatggacagcatctgcatgtcccgatcgataaatgcttccttcccccggtattctccgctgatcagctgcagcacaaactgcctgcgcagcgcctgcaggttattctcatcctttttaattgtaggccccaccttcaggacctcctccgccttatgaagggattccagaaggctctccggcgtcagattattctttatcagataatcaatggcattatgcttcagcacatctctcacatatttgtaatcgtcgtaaccgctcaggcaaatcgtacagatttccggatactccgccgagatccggcggaccagttcatccccgttcatctggttcatcttaacatcagttatcacaatatcgggatgcagcccgggaatcagggaccaggcctgttttccgtcgccgcattccccacagatgcaatagccttccttttcccagtcgatgagggaacgtaccatcgccctgctcggcagctcgtcatctaccaataacactctaatcatcttcttcaccaacctgatatcttttgggaatccgcagggaaacacaggtatagatgcctttttcccctgttatgctcaccccgtacctctctccgtaataaagctgtatccgtttctggatattgaacagcccgatcccctctccattccggaggttatccagaatcgccctgctctcctcctcactcagcccttttccattatcctccacgtcgatctgtacatcctcaccatcggaataaatggatacggaaatataaccgtcctccctttccatcacttcaccgtgcttcagggaattctccacaatgggctgtacgagcattttcaggatataacactgcctcagtccttcttcgatcttacatacgaatttgatccgggccgccttctggaattccttcatgcagacatatttattcagataatccagctcctcctgaaaggtcagatatgtgtttttggacatattcacctgcatgatggagctgagggcattcaccgcatccacaatggaatcggctccctgcatctgccccatccatttgatggtgttcaggctgttgtacagaaaatgaggattgatctgcgcctgcagggccctcaatgtcaaaaagcgcttttccttttcatgctttttcatatctgcgatttgttccttgatacggctgatcatatcctcaaagcggtgatacagcacctccgcctcatcaccggaatgaatggatatgtccagatacagattgtccttctgtatgctgcccaccgcatcggtgaggatttctatgtttttcaggaaacgattggccaggatgcggcagagtatcaccgcagccagggaaagcagcaccagaaccaccgcattgatcgacagcattctgctgtgctgtccggaaatctgctcatagggaatcagcacgatgctctgccatccggttacctccgacgtcatcttcatgagcagcgccttccggttccccagccttatgaccaccctgtcttccttttgggcaaatgcgcttatctcatccgccccggtcatcacggcttttaaaagaagctgcatatttctcatatccgtcagacgctcactgtcatcctcatagaaggttttattcagtatgggctttgccaggtaattattctgcaggacaaaagcgatgagacgaagctttttcagatagctttccacattccggttagccgtttccgtcatctgtccggcatattccactccgcgctcggtgatttcactggtaaaggccactccccagatcacggttgtcaccaggacaaaggccagaagaaggctggctaccataatgacaaatttatgcttcatgctgaaaaacgtttttttcattggatcaacccttcaccgcgccgtctgccagccctgccacaatgtatttctgcatgaacagatacaagatgacaatgggcatggaaaccaataccacatccgcaaataacagctgccagtccgacgccttctgccccataaacaaataagtggtgagcaccgccgtcgtcctcttcgcactgttcagtaaataaagcgagatcccgaaatcattccatatggacatcacgcagtgcatcagcgccgtgatggtcaccggcttcagcagagggaaaatgatacggaaatacataaggagcgggctcgccccgtcgatgatcgcggcttcgtcgatttcactggaaatccctttgataaaaccggtatagatgaaaaaaataaaagggaaaatgctggctgcatataccagtatagcacctgcaaccgctcctgttccagtggtcatatgtacttttgacagcataaaataaacaggcaccatggccagcggaagagtcagtcccatgacgatgaaattattcaccgccttcatggcccttgtttttcttctcaccacaacgaatgccgccatggaggcgcatgaaagaaccagcgccgcccccagaaaggtaacgaccgcgctgttcaggaagctggaaacaagccgcgcctcccggattacggtaccgtaattctccaggaactgttcccaggaaatcccggtcaggctcagctgcagcagattggcctgcctcttgcttttcatggaatttaagaaaaccatcagaaaaggaatcaggacaagaaagctgatcaggactcctattgtttcaaaaacaacctgtttcatttttttcttattcattataattccacctcatttttggcaatcgtccggtaggtacacaaggttatgataaggatcataccggccagcagcgtcgttcccgccgtagcttccccatatttctgatagctgtacgaattataaatcatggtgttgaaaacctccgtggcatagcccggccctcctcctgtggtcgccacaacgatatcaaataccttcagcccgccgataatgcttaaaacaaccacattattgatggaagccatcagaagagggaaggtaatctttttaaactgctgccatttggtggccccgtccataatcgccgcttcataataatccctggaaatattctgcatgcccgccagcagaatcatcatggtatagcccgaccatttccagatttcaataaagcagatggacagcatggctatgctcgtgtctgtcagccatttgggctggaagccggtgagcccgattgtcctcagggccgtatttatcaggcccttggagggatgcatcaaagaggtgaatacaattcctaccgcgatggaattgaccactgccggcagataaaaaaccgtacgcagataattggtggttttcagctttctgttcagcagcaccgcaagaagcatacctatggatacctttcccactgtggttaccatggtgaaaagaaacgtattcttaaaggcaatgctcatattgggattctttaaaatacttatatagttttccaaaccgataaaatcggcccttttaaaattccagttggtaaaggaataccggaagcccacaagaaaggggacaataaaaaacatgacaaaaagaaaaatgccgggcaggataaaatagaccgggtattgcttttttcttaacataaaccattccttccttcaaaagagggaggtgtcctgcgaagctctttcccggccgaatacccaaacccgggaaagaatcccgtataacacctcccccatttttcacactgtcaattatctgctttcaaaaccgaaacgctgtccgctgccttaccgaatcaatagccccagtccgggttccccgcttcttttgcataggtatcccagtcggtgtcatagcctgccagcacatccttcggggtcttatcgcctgccagcatggcctgtacatcactcgccatggaaggggtggaataaagggtattcggaagagtatttgtttttcccgcttccatcagtgcggatacatctgccggaatactgctcagttccacttccacaccatttacagccggaatgccctgatgcagcttataatactctgtcatcgcttccttcgataccagttctcccacgatctgtgccgccaaatccgctttcttgccgcttaccggaatcacgaagcctgtgggtgtttccgtataggcgatggaatccgccgcatccgtagccgggatggggaagaaaccgatattatccagctcctcttccgattccgccagcttggttaattccgcataaatccaggttgcctgaggatacatggctgctgtgccggtgagcagcgcttcctgggcatccgcatagctgtccgacaggaaggtatcctgaatatagcccttatccttcatttccttcatccgttcgaaggtgacctgcatatattccatatccgcccacagctttttatggctgttgagagcctcgatactgccgggctccatgctttcctgtttcaggcgggcatcaatgggtatgatctgaagcgtccactcattatctgtcgtccctgagatatacatcggggtaactcccgccgccttaagcgtatcgcaggccgccaggaattcatcccaggtctgggggatctgaatattgttatccgcaaaaacctgtttattgtagcacatgccgaatacggtcacatcaccgaagggcgcacatatcaatctgccgttataagtctggttcggggattccagaatgttggcattataatccttcgtccagtccccggacagttccataaataaatcttccccgatttccgttgcgctcgtcttcgctccctgccaccagaggatatccggaacctctccggactgcatttttgcaaaaataagctcattcccggaaccgccctccggaacttcctcaaattcaaacttcacattgcacttttctgcaacataatcaaacactgcattcgcttcatcggtcctccagctggaatggcacatgacattcagtgtttcccctccgccgtccaccgcggtattttccgccgctgcgctctcctggctttcaccggcctgcgttgcttcctctgtgctttccctgctctcctcctgtactgctgccgccggttcactcgccgcagagcctgatcctgaactgtttccgcagcctgccagagccgtcatccccatggctgcacataataaaatactgactaccttcttcttcattttcctctcccatctgtacgccctgtcgcgtacgcaaatcagggaagccgaaaacctttctttcagccagccccatttgttgtttcctgatatctttattctagcaaaacttcttttcaggaattgtattgtttttttagattcattacttaatttttggaaatcagggctgaaccgctgttatcaggaaaactgctgtccacataatcctacaactgccgtccacataattttatcatatacttgcagcctccttctgaatatggtaaattaaaattacttcttatttttatccggcgtatctgccgcttatttcctaatcaatacaaaatataaaactgctgttatgactgcagaatgaaagcgtggtgttttgcctatggtttaataatctattattttacgttgtaatctgttaataaaaacgatataatggaggtagacaaaagacttggaagttaaaatcacaaaagaatataaggatcgccttttccggttagtgttccgggaaaagaaggatttgcttgatttatataatgcagtcaacgacactcactacagcaatgccgatgaactgcatattgttactttggaaaacatgctttatttgaaaatgaaaaatgatatatcctttttaattggcgacatcctcaatctttatgaacatcagagcacggtaaatccaaatatgccggtaagagggttcttatattttgcggaaacttatcagaagtatctgaaaaaatataagtacaatctatatggaagcaagctgatccctctgcccaggccacaatatgttgtattttataatggtacggaaaaacagccggatcgttctcagctgaagatgtccgatgcctttccccactctaaaaccgccatggagccatgcctggaatgcaaagcgctcatgcttaacatcaacaaaggaaggaatcgtgaattgatggaaaaatgcggcaggctgaaagagtattctctgtttatcgcaaaggtcagagaaaaactgacattggatttacccttcactgaagcagtcgatatggcaatccgggagtgtatccgtgaaaacattctgaaggatattcttataaatcatcgcgcggaggtaatcaatatgttatttacggagtatgatgaacaggaacatatggccagtgttaaggaagaaggccaaaacagagtaaaccagttaatccgtcttctcatccgggaatccaggagcggggaaatagaaaaggcggttatggatcccgtttaccaggatcagctttttcaggaattcaacctctgatttaatgcactgcggcgacgccgaaaaaaacaggcgccgcatgcctataatctcttgctttgccaataatggtagtatatactaaaaaggcagcacagcctttgcttctgctgcctttacgcaaccagaaaaggaagggattatcctatgattcgttttatcagtgtagctctttttgtagttatttttcttatcctgagcattccgcttctcattgcggaatggattatcggcaaatttaatatggatatcaaaaaccgcagctccctggccattgtcaattgggcgttccgctggtgcctgaggctgtccggcgtgaaaatcacttatatcggtgaggaacggattcctaaagaccaggctgtcctctatatcggaaaccaccggagctattttgacatccttatgacttacgtacgcgttccccgccctaccggctatgtcgccaagctggagatgttgaaaattcctcttctcagccactggatgaaaaatctgcactgcctgttccttgaccgcaaggatctgaagcagggcgccaaaatcatcctcgctgcaatcggaaaaatcaaagacgggatttctatctgcattttcccggagggcacccgcaacaaggttgccgataccttcctgccgtttcatgcaggcagctttaaaattgcagaaaaaagcggctgccccatcattcccatcgccctgaataatgcaggggatgtttttgaggatcattttcccaagattaagaaaacccacgtggttatcgaatatggagagcccatttatccgaatgaactttctaaggaagaaaaaaagaagctggcggatatcacgctggaacggataaaagagatgtattttaagaataaggaattagtatagtacatatattcagcccgccggggttccggcgggctggatgtttatatcagtgaggcggacaggataaaggctttgaagcatagccgggaatgggaggcaaaatttatgacatttgaagaatgggtaaaagcagaaaaacaagaaagctgtatatttggcgaagaaaaaatactaaaattggtaagggttcttctgcaggataaccgcctggaagaattgtcacagatcagtgaagataccgcacttagagaacgtttatgcaaagaatacaaactctctgatatcgtctgatatacttcaggactggccatattcctttctgccagtctgatcaataaggccttcgggccggtctgaaaaatcttattaaatatctgaaaaaagtctgcctcctattattccttttttctctgggttggttatagccgtatcgtgtccaaaccgaagaaagaactgcagaagacagactttcaaatattttagttttactggtatctttactttattggataccttatccctattccgttacaacacccttctgcagcatcacattagcatacaccgccatttctccggttgccacaatggcataggcagtttttgcttcttcataaaaagcgaaccgctcaatatttcccaccactgcgcttcccctgccgtcatgcctggatataatatccttatactcgtcccagataggtgttttaaccggatctccgggcattacctccatgaggttaaccgggtgctccacataagtatccagcggaaatacctgaaggatggcatccagaatttccggaacgccatgtccgtccagccgtacgaccttagcatttttccccatggattccacaggaaaattaccgtccgcaattacaattctgtcactgtgtcccatttcgcacagaacctttaaaagttccggtgataaaatggaaggaattccttttaacatagcatcctccgatcaccaattcctgatatcttccctgtatttccggtataccgcttcccactcgtccggcctctgcggttcaaatctgcggatatcctccgaagccttaatgacactgcggatttcttccaggcttccgataacgccctccgccataagctggatagcgatattgccataaacagtcgcctcaatgggtccggcgtaaacagggcatttgcaggcatccgccgtcagctggcagagcagggcgctctgcgttccgccgcccaccatatggattaccggatattcttttcccgtacactctttgatctcttccagcgccatacggtatttcagcgcaaggctttcattgatgcagcgcaccagctggccctctgtctccggtaccggctggccggtacgtttacagaattccctgattctgcgcggcacatttcctgaaggggcaaattccggcgcatccggatctatcagagaacggaagggttcttccgatgccgccagcttttccaattccccgaagctgaactcttttccttcacgcatccactgccgccggctttcctggatcagccaaaggccgatgatatttttcaggaaggaaatctttcctcccacaccgccttcattggtaatgttaaaccgggtgctcttttcatttatgataggagtatccagttctgttccgaacaggctccaggtaccgcagctgatgaaaataaaatccttttccccggtaggcaccgcagccagggcacactgagtatcatggccggctccggccactaccttcatgggctccactcccagttcttcacaaatctccggcctcagcattcccacaggcgtcccgctgggaacgattttctgcaggagatgtcccggcagctgtaacttctcaattacttccccggaccattccttacgcaccgcatccagcagctgtgtggtggatgcagcggaatattcacagcatttttctccggaaagatagtaattaaacaggtcaggcatcataagaaggctgtccgccaaatccagctgccgtttccggttcagggataaatacagaagctggaatacggtgttaatctccataaactgattgccggtgatttggtaaaaccgatccttatctatgctttcaaagcttttttccaacattccggtcactctggcatcacggtaatgcaccggattctccaggaggtttccttcttcatccaggataccgaaatccacaccccaggtatccacgctgatgctgtctattttcccatacgctttggacttaatcagtccctgctttatttcatgaaacaggcggagaaaatcccaatacatggttttccccagaatgacggggtcgttggagaagcggtgaagctcctccacacttattttttccccgtcaaagcttcccagcatgactctgccgctggaagcccccaggtcaactgccaataccttctttatttccataggttcctcctacttgtacagaggtccgtaagcctcacatgcacggtagtcctggccttctttatccattccgaaagcattccatgcggaaggacggaaaatcttttcttccggcacattgtgcatgcttacaggaatgcgcagcatggagcacatggtaatcagatctgctccgatatgtccgtagctgatggcaccgtggttggcgccccagttattcattacatcataagccgttgcaaatgcgccctttcctgtggtgcggggagcaaaccatgtgcagggccatgtatagtcggtacgtttccaaagcttgtcggaaacctcatccggcagcttcactgtccagccttctgcaatctgaagcaccggcccgagtcccttaacaaggttcagacggatcatggtaacaggcatttccgcctcggtaaggaatctggaggaatatccgccgcctctgaagtagccgaaatcagctgcattccaggtagtggcacccataatagccttctgatcctcttccgtaacatcataccagggcttcatcacaccattgccgttttcatcctttgcctgtccgttggcatccagacatgcagctccggaattgatcagatggataaatccgcccgcatcctttgctactccatcgatatcatagccggttgccttcttaaccgcttccgggctccagtatgtacggacatcggcaaaaatctgtgcacggttggtcagaagcttcatgaacatcattcccagtccgttcagcacatcattttccgtcgccaggacatacggctctctcgccccattccagtcaaaggaggtattcagcatcgcctctgcaaagtcacagttgggatagaagtctgtccactgacgctgtccctggaagcctgcggcaatcgcattatggcccaccatctcttcttcgcagcctgccggaagattcttattgccgttcatcagatccttgatgatgcacatcatcttcacaacgaactcccagtcctcatccttcttttccctggacttctgaacctcttcaggattcttatcaaagccttcgatgcagtttgcttttgtccaggcaagagctttctcaaattctgctttatcataaatgccttctgtcatgcggcggatgatttccacttcatccacggattccacacgcatacccagatattcttctataaatgccggatcaatgatggatccgccgatacccatacaaatggaaccaatctgcagataggattttcctctcatgctggcaacagctacggcagcacgtccgaaacggagaagcttctccactacatcctccggaatatccgtagcatccgcatcctgcacatcatgtccgtaaataccgaaagcaggaagccccttctgtgcatgggttgccagaacgcttgccagatatacggcaccgggacgctctgttccgttaaaaccccatacaccctttatggttctgggatccatatccatcgtttctgcgccatagcaccagcagggtgttactgtcaaagtaatatccacgccttccttgcggaatttgtccgcacatgccgctgtctctcccacacgtccgatggtagtgtctgcgatgataacctttaccggctcgccattggaataacgaaggttgtcttcaaacagcttcgccgccgctttcgccatattcatggtctgctcttccagagactccctcaccttaagatagcctcttcttccgtcaatcgtaggtctgatgccaattacaggataatcccccacatatctgttttctgccatttttctttccctccttgttaaaataacacaaccggtttctcttcggctttccgtaaacacatcaatacggattatgcccgttatgttcagtatagcattggcaattttgttttgcctgtgttataatggcaaaaaatataacaatattcactttttattctttcttcccttttatcggtaaaaagagaaaaaacaattgcggcagaggcttctgcgtgggctttttcggaggaaaaggaatgcattatctggattataatgaaaaaatagaacatggcacccctgattttcccatcgccttttatcatgtggatgagcaccattcccgctataacatgcccttccactggcataaggaaatggaactgattcaggttcaaagcggctctctgcgcctgtttctggatgatcgggaaatccttgccggggcaggcgacgtcatcctgatcgaggaaggggtcatacacggcggcataccggagcactgcgtctatgaatgcgctgttttcgaccttaaatccaccctgatgcatacggacgcctgcaaacgatatatacgactcatttcccgccatcaaatccagctgtataattattttcaggcggttccccgggaaggaaccgtccgggatccttcggttctgcccggcgcagcgccttcctccagggacaattcccgtctgcttcaggccgtgagaaggctgtttgacgccataaggtatcctcatgcgggcagcgagctgagtacgctgggcgcgctgtatgaaatcttcggatgcctttttgaggaagaatattatatcccggtgacggatgcccctgctcccggacagaaaaaaatggatcagctcaagcctgtgctggaatatatcgactctaattattccagcccggttaccctcgctgatctgtcgcgcattgcaggaatgactcccaagtatttctgccgctatttccgggccgccatacaccggacccctatggattatttgaattattaccggattgaacgggcctgctacatcctcagcacaacagagctgcccattacggatgtcgcttatcagtgcggctttaatgacagtagttattttgtaaagaccttcaagaaatatatggatgtcacgccgaagcagtatgccctccgcctgtaaaaccggatttctgagccatcaaaatcacggctctccggctgaaaaaactcaggtaatgatccttaggtattgatcgaagaaagagacacatgccgccgcaggcatatgtctcctttcgttttcagaatgtttgagactgaggtttccaaagcagcactctcctgacagcgttctgacaccaggctgatcatcaaagctccgctctgtttacttatgtattctcaggaaatacggttgagccactcttttcacataaagattgtcctttaaaaccatgattttctctttatcataaaaagagagaaaagatcctgcttcagaagcctctgaagaaccggactccggtatggatgcggatggaaaccacatcgaaaattcgttctgtcgatacttaataagcttttatatgattaataataatgcaatgtgcagttcctgtcaactgattttcctcttcgcgtaactattgtaagcatgctttttattcttactctgatattctgcgcgtgcacctttttgccccacgcaattccaggaaatacggacgtaaaaatgttctttttttaacgtaactgctaagacaaaaataacagcgcagtaccggctaccggtcctgcgctgtcattttttgtcttagcagttatattcagatctcataccagattatctggttcggctcaagatccagttggaaggctgtgccgtctcccttataaacggtggttgactgcgcttcataggtattattaaccacacagtatttcccgttcttgatataagcatgcacttccacattgacattggtactgaaccacttgttaatgttttcttcatccccggcgctccacagaatagcacggtaaaggagcctgctgttctcaaagctgtagggaagcccgctgatatatacggcgcggccttttccgaattcatttactgcaagatgtacttccttttccttcgcttccagcaccgtcgcgttttcaagggcataaatatattttcttgattccccaaaatcaatctcgccctgggcatcggccgtaataaagtggtcgtggttttcccagttatacttatcatagccgagtgtgaagtctctttcctcttccacaccgaatacattggacagctggaagaaatgtccgttggcctggtgcccgctgggttctcccacaccgataatgccgccgccattgtatacgaattcctttatagcggaagaaatcaccggattgcaccaccattcgccgccggtatgtgccgtatccgcatcacccacattgatgatcacatcgatatccttcaaaatatccttattttccaggatatcctcaaagcttataaatttcacatcaaaaggagctccggaaagggcttcgataatgcccgcataggaataattctgcttgaagtaaatggcatgatgcaccatatggcagccccaggctctcattttgccccagcagttaagtacagcaaccttttttacacaatagggcgttgtacccttaatattttcatataattcccggaattcctcacagacggattccacatattccacaaaatccgggaactcattcgccagcttcagatatccgccgtaaccgatacgatcaatgggctttcttaaaatagcgcgtcttgccgtcacccagttatattttgcttctttaaccggatctcctccctcatggaaggtatcggggaagaagtaaggaagaaggcgcccttctgtatatttaaccccttctatatcgctgataagacgtaaggttgaaccattgcccacgcttcctaccaccgcatccagcccgatgcttttaaattcttccataaacggttcggtgccgatccaatgatcgcccaggaacatcatggcttccctgccgcattcgtggcagatatccaccatttccctggcaatcttcgccacttcccttctctggaaagcctggaagtctttaaactcacgggaaggaatcctgtactggttattataatagccctgatcgataatatattccggacggaagggatatcctgcttccttttcaaactgttccaggatataagggctgactgatgcggaatagccataccagtccacatatttctccctcgccagttcgtcgaacatcagcgtaaactgatggaagaacgtggtgaaccggagaacattaacataaggatgctcttcaatgaacttacgcagacgcttcatcgtatattcatgcgtcttgggctgtctcacatcaaaggtgatctgatgctccacatccttccagtcatttacaacagcgttatacatatgtaccggatcccacatgatataagcgaggaagctcactgtataatcatggaagggaatgctcttaatttccacctcaccggaagcctcgtcataagaccagctgtccgtgggaaccacttccccggtgctcctgtcaatgacttcccaccagcgcctgatatcatcccggcagttgggtgtgagcatatccggatataagcccttcatgaggcgtatcctgaggctgtccccgtctgccgtgtaaatgggcgtcatcacatacatctgctggatttcatccggattggctttcgcccagtcattatctttcctggttgtataataggtggaatatacctttaagcccacatcctttaactctatggggaagtctgtcccgtcgcagtcacgcaccgcgtcggccccccagcgcctggataattccagggtctcctgaatcacatctacatctgtaggaattgttactcttcctttattctggtccatcctgcgacccctcctgtttttcattttatcctttattcacaaggaaatcagcctttgataccgccgcccgttacaccggcaataatcttctccgataagaagatatataataagaaggtaggtaaaaatacgatgacaacggctgcaaacaatccgccgtaatctcccgtgtatttcatggagtttacaatctgcagcaaacctactccgacaggcgtcatcttttcggagcttgcaaaaatcaatgccatgaagaattcgttccatactccgaggaaattgaaaatagtaaccgtaatcagcgcgggctgaaccagcggcagcatgataacccagaaggtttttgccggagggcatccgtcgattgccgcagcctcttcataggttttggaaagggttgcgaagaagttgagcagataggttgtggtataaggcacatttaaaaagatatacagcagtatcagcagaatcctgccctttacattccactttgtggtcaatgcaaaaataggcatgataatcataactgcgggaatactcatggctacgatcaggccggatttgattgctttattacaaatgaaatcaaatctggaaagcacataagcgcccggcgcggatatcagaataacgccgacacaggaaacaaccgcataaagcagcgagtttgcgaagaatacggaaacgttctgcgcctgccatgcgtttacatagttttccaaatgaaaaccactttcgaatttgaaaacagtacctgaaaaaatttccctggatgtggaaaggctggcccccagaatccaaaacaaaaaggccgctgtaaatataatccagacaagtacaataatataaccgggaagaagggacaattcctttttccagtttaccttttgcttgattttagttttattttctttactcatcattcactccattctgcagacaggcatgtactgcgttccatcctgccgccccaaatcccttagacggtgtctgacagacaatattccaacctgcttaaaattccaaatcatcgtccttaagcagtctgttcataacgaaataaaccactacaataatgagggcaaggacaacgcctaccgcagcaccggctccggcatccctgttcgcatttccttttccgccgaataccgtatcatacaggtaaacaaccggaacaatggtagatgcttccgtatccaccggcgagaacatctttgaccagaggaagaaggttgtggtgtgaacactccagaaggttatatttgttttggtaattccctttaacagaggcatggtgatttttccgaactgctgcaccttattggctccgtcaatggttgccgcttcatataaatcctgagggatccgttcaataccactgataaaaatcagcatgtaataacctactgcgccgaaaatgaaggcaaacagcatggcccagaacttcgtatcggttcccagccatttcacgccgttaaggccgagggcacccagtaacttgttcagcataccgtaatcattgttatatacgtactgaatccacatggtcgccagcgctacggcactgataacgttaggaagataaattgccgcacggaagaactttttaaaacggatgccgcttgtgaggataacggcaaagagcagtgaaaatgacaatgtaaaaataccgccgaccagccagatacggagcatgttccacatggaaacccggtatgtggggctgccgaatattctggaataattgcccagtccatagaaagaccatgtggaaacatcagacgtaacactttcaatccggaaaaagctcattatcagtgttcttgcaaccggataaagatacataataaataaggtcagcagacatggcagtataaaacatatgatcatagttttattttttttcatttatacgtcacctcattttataaaaagaggcggcaccactacagtgccacctccaccgggtaaacccttttttagtataaagcgtccattgctgcagcgaaatcttcgccggtagcatatttgccttcgaacagtccgatgatgatatccttgaagttagccttcaggtctgcattttcattcagtcccatgttccatgtaagcgggctgccggtagcctgaagagcttcgatagtaccgttcatgatagcgggagctgtatttctgggatccgcaggaatctgggaagctgcatcagccatcttctggtcaaattcgccggatgttaagagcataaggaaatcgaaagctgcctgagggttctcgctgtaagaggagattgccagagagttggcacctgcataagcgttggaaggatccgcaccgccctctactgcaggatagttgaacattccccagttaacctcagtaccgctgttgttgttaacttctgctgctacatagttagcacatacaaccattgcaaccttgcctgtaagaccgatcttgttctggctggaaggatattcatccggagcgccgtctgcaagatatcctgcttttacaaagtcaataatctgctgagctgcttctgcaacgcctttgttctcgccccatccgccgttaagagccaggtctgtaatcgcatcctgtccgataactctgtcaaggtgataaccgaaggtaaagtctgcatatgcgctgtcaagagccagtggctgatatcctttgtctaccatggtctggcatgcagtaaggaattcatcccatgttgtaggtacgctggtgattccgcagtcatcaaagatgtctttgttgtagaacacaccgccaacctgaggctgttcggttacgcagcagaggaagcctgcccattcggtagctacatcattgaagcacttgaagctctgtgcatcgtagttggctgctttagccatttctgttaaatcgtagcagtaatctacatatgtttttgcgattctggagtagtcatcttcaaagatgtctattttttctccggattccagggctgttgcgatgatagtattgatatcacggcccttccattcgatattcacggtagcgcctgtctgctctttaaaagcatcggcagcttcctgaattacttttccctgaggctcagtggagttccacatggaccagaaggttaatgttacgtcgctgtaatcagcagcgccggcatctgccgtggtttccgctgttgtatcagcaggtgtttcttcctttgcttcttctgttgctgcaggcgccggggtctcagccggggtgctttcagcaggtttgctgctgttgccgcagcctgcgagcaggcttgctgccattacagctgttaataacacactgacaatcttctttttcatttttttcctcctttagtttgaacatttccgtattgctttttgatactatcagtatatcctctataagatatccatacaatccatatcttgcttcattttttataaatcttgctttttaccctatcatttgataaaatacttttagtaacttacgtgcatcaaaagaaataatcgaatattttttacaacaatgtgcttaatttgccaatttcaatttttgccgtttttgtatttttgcacatcttttttgtacaaatgcccggctttcttgcacatccgcttttacgcaacgcagtatttctaaaaaaggaggctttttatgcctatttcaagatattcgatggagaatgataacatcaatcccatcaatgccaagctgctgtatgtgacccattccgtttatgagaatgactggcccagccttcctcatacccattactttacggagctgtgctatattaaaagaggaaaaggcaattatctgatagaggatcagatttatcctgtgaaggaggatgacttcattattataaactccaatattacacatacggagcgttcggtgggtgatattcccctggaatacataatcctgggggtcgaagggcttaatttttcctttgaagaagatcatgagcatatcattttcagctgcaggaatgatcatgacaagttcatgtaccatatgaacgggctgctcacggaaatggaggaaaagaagcccaactatgagctggtatgccaggatatgctggaaatactgattgtcaatctgatacggcgggcacattttgatttcgagtctgtttcctccgtaaaatccagccgggaatgtatcaagctgaagcagtatattgagatgaactatcctcaggatatcacgctggacactcttgccgaggtatctcatctgaacaaatattatatggtgcatgcctttaccaggcagttcggatgttcgccaatcaattatttatgcgaagtaagaataaaggccagcaaagagctgctggccacaacggattacagtattacggaggtcgcccagtcctcgggcttttcctctcaaagttattttgcacagtgcttcctgaagcactgccggatgactgccagcgcttaccggaaggcctgccgcagtgaataacaggcgtttacagcggcagttcatactgcccttccaggcaggatgaggtcttgcgcacggtcactttttccccgtcccggacactgcccacaagcagctcgccctgcctgtccgctttacgcaggttttcctccagggatttgggagaatgattggcatagcagtaaatacaaccgttgcggcaggtattataggcgccgatatctatgctttcatagcagccgcagccctttcgctgccccttatccggtttcagtttgaggtttccgcctgtgatatcctcgattaccgccttgtcaatgcaggaagccctgcccacgccgaacggagtcagatccttcccttcacagcaggcgttaacggaaagcccccgggcggctgccgtatgggagaaaaaggccgccagttcttccatctcttcttccgtcaccggacgcagctgcttttccgcccgggatcgcagcgcctcttcctcttctttctcatatgccggagcctttcctctgccaagcttcgtatacatatccacaaagcttatcgtaatgctccgcatgccgccctgaagttccctgcaaagacgttcaaactcctttttatgatagttcagatccagaacctcattcaccaccacaggatcatagcgccagattatgcgctcaccgccaactcttcgagccagttcccggaaacagccctcgatttcttttttatcgcgcagtccgggctccagattttttccgtacggcgtcagggtaaattgaaaataataccggtatcccctggcatcgagttccttcagataaggcatgagaggcgcaggatccttgctccagaacacaatacagtccaccacgtcaggcgtgagggctatccggccaagctgccccgggttcatgggatttcttaccaccgcatatcccgcgcggatacggttcatgaaccattcgctgtgccggcacggtatatcggtgcgtctggatacggataaaatcatgacagctgttccaccactttctcaaatcccatgccatgggaggctttgatcagtatcgtatccccgggcttcagaatctggtttatcccttctaacaggctttcccggtcttcaaaataaaaaatttccgccgcgggaccatctttcctttccccggccgcttccctggctccctcatagatacagcgggccagctttcccgcgcagataatacattccacgcctttatccgccgcatattttcccacgcgggcatgcatttccttttcctgttctcccagttcaaacatatcgcccataacggctaccctgcggccatccgcttggagcagcagatcaatggcggcctccatggaaacaggattggcattataacaatcgtctatcaggactttatccggcagcttcacaatatggctgcgtccgctgacgctttccaccgccgcgatgccatcccggatttcctccggggtcaatcccagcagcagccccgccgccgctgcggccagcgcattatataccatatgttctcccggcagagggatctgaacggcaaagctctcgccgtttccatggatgacggcctcacttccgaataagccctttccttttatgtccgtggcatatacccggcattgctccgacagcccgaaggtcaccggtttcttcccctttacttccttaatggaagcaagcatatcgtcatcaccgtttatgcagacgctgccgtcctctttcataaagtcaaacatctcggatttcgccttcaggatcccttctctgcttcccaggaattccagatggcattggccgatatttgtcataatacagatatccgggcgggcgatgcggctgagattatgcatttccccgaaatggttgatacccatttccagcacggctacctccgtatcttccggcatggacagcacggtaagaggtactcccacttcattattatagttgcccagggttttgtgcaccttatatttcatggagagcacggctgcaacgaattccttcgtgctggtctttccgacgcttccggtaattcccaccactttgacaggcagctgctgccgatagaattccccgatctgtttcaaggcctcaaagctgtcctccacgacgatacaggggccgggtaagcttttcggctccttttcacatacaacgcccagggcgcctttggcaaaaacatcggggataaaccggtgtccgtccacccgttccccttttgtggctacgaaaatgaaattttctccggccttccgggaatcaatcacaacacctgcagcctccaggtgttcggtttccttccgggaattctccgcaggatatatcagccttccattacaggcatcagctatgttggttaaggtcatatttttcatatcttctcccatctgctctgccggaatcattcgccttccttcagagccagttccataatccattcgcacaaatcttcaaagctgacacccatagcctgcgcctcctggggaatcagggaggtaggggtcattccgggaagggtattggcctccaggcaataaagcttaccatcgccgtccatcataaaatccatgcgtgcatactgcttcagccgcagcgccgcgaatactttttcggaaatcgcctgcatttcctccgctttttccttcggcagatcggccgggcaggtttcgatggtgcttcctgcctggtatttatttttataatcataaaatccggtgagcggggcgatttcaatgacaggcagagcctttccgtcaatgaccgcacaggaaaattcccttccctggatgtattgctcgattaccgcttcttcatcatatcgaaaggcttcctcaagagccgcctggtattccttttcatcatgggcgatacatacgcctacgctggagccgcctctgcaggcctttaccacgcaggggaagggtactctctgtgtactttcctctccttttttgagatgggttcctgccggagtcggaatggagtgaaaggcgaacagttcctttgcgagacttttatccatggccagtgcggagctgacataatccgtgccggtataccggattcccagcaggtcaaaggccgcctgcaccttgccgttttctccgtcttcgccgtgcagccccagaaagaccacgtcagccatctggcagacagggatgacgcccgggccgaaaaagctttttccgccgtctttgcgcagcgctttaatgctggaaatgtcgggattgctctccgtgattcctccgatgttttccgcccagtcgatattcttttcaaaaatatcctcataatccccttcatatcctaaatagacatccagaagaatggcctggtgtccttttttcttcagcgcttcataaatcatccggctggagctgagggaaacgtccctttctgtgctgattccgccgcctaaaactacgattttcatgcatttcctccattttgctgtcctgatgacagattttctttttgggtgacagcactgatgcaaaagttgttacctttatttaccatattttttaccgtgcctgtttatgcaggaacggggtggatttttgcctgtgcttctcaattgtagcatatatgggggtattgtaaaatgaaaaaaatgcttctttttttgcgctttgtgctgtgggagtacgcctcccgccttgcacgcttccgtctctgtgctgtttcctcccggccctcttccgccttccgtcccgccgcaggccctctgtatgtacggcagcagacaaaaaaagggggtgtttctaactgttttgcctctatcttccgctgccaacgcggctgaaactcctcccttcggtcgtcagacagcgccgctaagaacgggcagcggaagatagaggcaaaacagtaagaaacatctccctttttttgagatgccgccgtacatacagagggcctgcggcgggacggaaggcggaagagggccgggaggaaacagcacagaattcggaagcgtgcaaggcgggaggctgggggtatgtataagaggtaaaaaaggacggggataatgaaggagcctttgcctgttgggagggatgggggataacagggaaagatccttcattatgagataagggaggggatttaatataagtgctttatggggggatgggttaaaagttttcgtcgcggtaagctatggtgccgtttatgatggtgcacatggttttggtgaaggtttccatggggttgccggtgaagatggctatgtcggcatctttgccgggttcgaggctgcctactctgtcgtagacgcggcagattcgggcggggttgcaggtgatggcgcggaggccttcttccatggggaggccggattttacggcgaggccggcgcagagggggagggattggatgagggtgacggggtggtctgtggtaatggctaccaggactccggcctggtggaggactccggcggttttgaaggccatgttctggacttctattttgctgcggctggagaggtcggggcctattatggcggggaatccttcttttgcgagttcttcggctatgaggtggccttcgctgcagtggtctagggtcatggagaggccgaattctttggctatccttatggctgtgaagatgtcgtcggctcggtgtacgtgggctttgagggggattttgccttcgagtacggggagccagggttccatgcggaaatcgggttcaaaggaggaatcgggggatgatggggattttccctgattctttttttgccaggcttgttttttcttttggtactctctggctttgaagagttcttcgcggagcaagccggctatggccatccgggtgacgggggatttttgctggtccatgaagtttactttggggttttctccgaaggctattttcatggcagcgggttctttgacgattaagtcgtctatgcggcggcctttggttttgaggaaaacgaattgtccgcctactacgttggagcttccggggcctgccatgatggaggtgattccggcgcggacggcgtcgtcaaaggctgcgtccatggtgtttatggcatcgagggctctcagccatggggtgacgggggatacgttttcgttgcagtcgtctccttccatgccttttttctcttcggtgattcctacgtggcagtgggcttcgattaagccgggcatgaccaggcagccggaggcatcgataatttgggtatctttgtcctccggtatttctatctggtcggcgactgcggtgattctgccgttttctgtgagtacgcatccttttggcaggacttttcctgccatggtcagaatgcgtccatttgtgatcagaagctttttacacatttcagctcagcctgttcagcggatttacgggttgaccgtccttggtcagtttgaaataaacattgcagccttccacactgtaatatttcgtgggttccgctacctttcctataatttcaccggttgttatgacgtctccctctgctacggtaaggtcggtgagctggccgtaggtgagttcgtatccgtctcccaggttaactactaccgccattccgatttcgggatcttcgtagacggaggtaacctgtccgtcggctgctgcggtgatgccttcaccctgtgttgcggcgatgatgatggcgggattatatttgtattgctgaagggttgcgaaataaacggtcttgtccatgctgtagtttaccaggacatttccaacgatgggccatacaagggtatcgttgtccgtaaagtccagggcaggggttgtgttcatggcgtcttcatcacgttttgcggtatcggtggaatcgtctgttttggcgatgacatcagccgcattggcttccagagcttcttcttcggcaggatcagcggctgccagatcctcttctttggatgtcaggcctgcgtcggcgaggccttcacctgcctggccgttttctaacgatgcctggcctgctgtgcttcccagcatattcattccggggttgtccacatttccggaattcgcttcctggaagctgggatcgtagtccagttcgccggtatctgcatactggccgtctcctgtacttccgtccgcctgggcttcgccagctttttgtttattggattcttccaaagcggtgaaatccaccacatatccgtcttccttatcctgacttttgtttcttacatacaaaccggttgctgtcagcgccgtcagaacgaggcagctggacaccagcatgatcgctttttcttttctaaagcttgatctccttcttcttctcatagggcattccttctctttcctattcattttggcagatgccaattatcagttgaaatccttcaagcttagtctttccgttttcccttcctttattcagttttttgaatttccacgccttcaaaaaaaacatgcagcaaggccagaaaatcttctccctgtaccgcccttctgttggcttcaaactggcagaaacctagtccgtggcctactcccttgctttcgagcgtcacgtttcctccgttttcacttatggtaaaacaggcggactggagggaaaaaaggctgcggaatttttctcccgacatatgtataccggccgcttccacccacagcacataaccggcgctgtctctggtcaaagttattttttcggagccgtcaacacccatggccgcccagaaatctttttctttgagggtgactgtgctgctgtagccggacgcttctatatcatggctgcagtcaacgctggtcaggtagtcatagccttcaccgaaaacttcttttccgtttcttgttttgccggcgctgagccagaaataggcgggttcaataatctggccttcccaggtcatatacatgccttttgtctgtgccgccgcagaagctattttggcctgtttttcttcatagctgtcttcccagagggcttccctgctgcgcatatccagatattcctggccgatatccctggcatagacggtgttatcatctatggattgtctgttttcataggctctcatgcagagggtgcggagaattatggcctgggccttaagtgtttcctcttcacagtccgccggaatgcttgcggcgagagcaccttccacataggtttccaggggaagcctgctcattccgatgccggtatcgcaggctaccatgatactgctttcgtcccgtggtaccgccagagtttcttctcccacatcgccttttccgaaaagcaggctgcaggcatagggaagaagcagcaaaaataaaagcaccgcacataggtccaataatcgctgacggcctgcggtacttctgaatgcgccctgcagcggtctcctggaagcaggccgcgctttcggtaataaggaatttctgtccatgggcatctctccctttcctgcaaaaatttacgttgtttacataactttcacgcatgcccctatactctccggccattgatttcgggcccgccttccggttcggcttcccctccttccctctgcggctgcggccatgcagggatccttaaaggggacgctctcgctcggataaacacgcagcggtactaaggctgcaaagtacgcagcctaaggaccggcgagtttatacgccccttacaggaaaccctgcatggccgcagccgcagagggaaggagggaaagccgaaccggaaggcgggcccgaaatcaatggccggagagtataggggcatgcgtgaaagttatgttactatattttatgttgtaaaaataaaattattcgaaagcaggtaacggaacaaaggatgacgcgttctgccaggtatctctttgcgcgaaaaaagccgcatccttttcaggatacggcccgtttgctttttttatactctgttgtagtttatgaggcagccttccagaataatccggcgctcttcctttgttaaatctcctaatgtgagagtaaaggacttcagcccgtcttccttcaccacatatgcggtaatggtgccctgttcttcttccacggctttacgaattccgggaataaacaggtaatccaggttggtgaaaggcagttccccttcttcaataaggaaaggaagcattccccagttaatcaggttggaacgatatctcttggtcgcatattcgttggcgatgttcgcccagccgcccaataccttctggcagctcgccgcctgttccctggcggagccatctccgggttttacggcaaaaatagtggatccaaagcctatgtttccttctcccacatccgggtactgtttccggattgtgcccattacaggagcaagttccggtttttcttctaccgggcatttcccttccatcactgcggtctgcgccttctggatttcctttgcccttcctacgtaagcgggatcctttctggataaggtgaattccgcaagacccagagggttggaacggtaggaggaggtttcaccggaaggaatcagctcgtccgtggttgtgaccggatcatggatttcggaaaccacctgaagcaccatgttttcaggaaggctgcacatcgccggccaatccttgatattgggcccgaaatggatttccacatccggatctgccacgcccttggaatcaaatacacgattctcatagattttggaatcaaagtggtatttatattttccaaaggtcccgtcgaattcggtagcgggtgtgaggacacctttgtttgcggctgttgccgcgatggaacgggcatccatgagtgcgacggatgcgatctggccgttctgcagcttgcttccttccctgttggggaagtttcttgtggagtggcggatactgaagccgttgttggcaggcgtgtctcccgctccgaagcagggtccgcagaaagcggtcttcatgacagcgccggtctccaggatggtggctgcactgccgtttttaatcagttccatataaacaggcatggaagccggatatacgctcagggtgaattcatccgcaccgatatattgtcctttcaggatatcggccgccgcacagatgttttcaaaaccgcctcctgcacagcctgcaataataccctgatccacacagaatttaccatttcttactttatcccgaagggaatattccacagcgccgtcaaggcttaccgccgcgcgcttctccacttcatcgagaatatcctccaggttttcattcacttcctggatggtataggtattgctgggatggaaaggcatggcgatcatcggccttactgcggaaagatcaacgcagatcataccgtcatagtaagccgcttctccgggagccagttctttgtattcatccttcctgccgtggatttcataaaattcttcaatttctttatccgttttccagatggaggaaaggcaggtggtttccgtagtcataacatcaattccgatacggaaatccgcgctcaggcgttccacgccggggcctacaaattccatcactttattttttacatatccgttcttaaatacggctccgataatagcgagggcaacgtcctggggacctacgcccttcacaggttctcctgtgaggtatacgccaatcacgccgggcattttgatatcataggtctgattcagaagctgcttcaccagctccggtccgccttcgcccatagccatggttcccagagctccgtaacgggtgtgggagtcggaaccgagtatcatcttaccgccgcctgccagcatttctctggcaaactggtggataaccgcctgatgagggggtacgtagacgccgccgtatttctttgcacaggtgaggccgaataaatggtcgtcttcattgatggttccgcctaccgcgcaaagggagttgtggcagttggtaaggacataaggaatggggaatttggtcaggcctgaagccctcgcggtctgaataatgccgacaaaagtaatatcatgagatgtgagcttatcaaatttaattttaaggctgtccatgtttccggatgtattatggtttttcagaatgccataactgattgtttcctttgacgcctcttccttattcatctgctttccggtttttgcagcgacagccgccgcagcttcctggttgtcagggatgatctccgtgccgtttaaaagataggcaccgccttccagtaatgttaccatgtgattcctccttctataattaatgaaacaataaaacttttcatgttgggtgctgatactttattatagaggaaagagaaaaaggaatcaatcttaaattgttgcttgtttaaaagtattggttgtgggttcaagagattcctgtgtgccgatgatgcctgccgggcggcctgtccctgcccttcctgcgcggggcggcggttctgcaaggttcctgtgcaggcacgctttcgctcggataagcacgcagcggtactaacgctgcaaagaacgcagcggtactaacgctgcaaagaacgcagcgtaaggaccggcgtgcttatgacggcctttacaggaatccttgcagaaccgccgccccgcgcaggaagggcagggacaggccgcccggcaggcatcatcggcgcacaggaatctcttgaacaggaaggttatttgttaaagtgttgctaaattgtagatcgaaatattgatactagacttggggtctgataatgtaattataaaaaagcagaagagggtgagttttttattatggaagaatcagatgacggtggtgggaatccatgtcggtttcggtcttttatagttgttttgctggaatgatttgggtatggatatttcagggaactatagtgggattgaaatatggaaggatttttacggatgaacgttactttgattattattttgttgtgtattattatgtctgcttatttttcggcgacggagacggctttttcttctttgaaccggattcggattaaaaatatggcggataaggggaataagagggcggctttggttttgaagctgtcggaggattatgacaggttgttgtctactattctgattgggaataatattgtgaatattgcctgtgcttctttgtctactcttttgtttgtgcggcttttgggagaagatgcgggggcgagtgtttctacggcggtcactactgttattgttcttgttttcggggaggtttctcctaagagtattgctaaggagtctccggagaagttttctatgttttctgctcctattctgaattttatggcggtattgcttactcctcttaattttctgtttaagcagtggaagaaggtgctgtcgaggtttttccattcttctgccagtcaggggattacggaggaggagcttattacgattgtggaggaggcccggcaggatggggggattgatgagcaggagggggatttgctgcgtaatgctcttgaatttaatgagttgaaggctgcggatatccttacgcccagaattgatgttgttggagtgaatgtttgtgccggggcggaggaaattgcttcggtatttacggagacggggtattccaggcttccggtgtatcaggatagtattgataatatagttggtattctttatcataaggatttttataataaaatttatgggacgggtaagggaataaaggatgtgatacgtccggccctttttattacacggcataaaaaaatcagtcagctgctgcaggagcttcaggcttcgaatcatcatattgctgtggttattgatgaattcggggggactgtgggtattgttactctggaggatattttggaggagctggtgggtgaaatctgggatgagcatgatgaaattatccggtctgtagaaaagctatctgatgatgagtttcttgttttggggaacgcaaatgtggataagcttttggagctgctgggttatgatgaggaaacagaagcggttacggtaaacggatggatcatgaatgagcttcagaagcttccggaaaagggggattctttccgcttccatgaatggcagatcactgtaatggagatggaagagcggcgtgtgaagagcgcccggatctgccggtgtgaacagtgctaaacagatgataggtctgcgggccgtctttatttctataaaatgccggtccggattggcagcagcaatccgggccggcattcttttattttttaggctgtatggataggtctttttataaatacttttcagcgatgctcatcatttcgtcccatttgctttccatatccgctaccagcttgaactgggtacgggcgcggtccaggttgtgttcggggcggtggattttgaagtaaacgtcaccctgcaggtaatcggcgaggaagcgcatgccgcattccagggtcatcagtttggctcccatgggaagcatgcgtatttcttcttcggtcagactgcctccgcagccttccacatatccttttgtgtatatttcaaacagcttcagatcacagctgatcttatccaggtctttctcatcctccgctcccgtgctggcgccgaaacggatggaatcgccgtagtcgtaaagggcggaacccggcattacggtatccaaatcaatcacgcagagtccttttccggtcttattgtctatcataatgttattcagcttggtatcgttatgggtaacgcgaaggggaatcctgtgtttggcaagggcatcgcagataacatgggtttccggctccctatccatgacaaaccggatttcttcctgtactccggcagcccttttacaggtatcttcctccacggcttttctgaaatcttcaaaacggctcacggtattgtggaaattcggtatcgtttcatgcagtgttgacgcaggataatctgccagaagcttctggaaattgccgaaggaaagtgcgctgttatagaagtcttcgggtttttccacgatatcaaagcaggtggcgtcttcaataaaaatatacattctccagaagtctccgtcttcatccacgagataattgtccccgtccacagtgcggataacattcagagtctccctgtcgggatcccctccgttttggatgattttgttccggagaaaggatgtgacgttcataatattttccatcaggcccttggggttcttaaaaatatcatcattcatgcgctgcaggatatagcgtctggttttcccgttttccagttcacaggtcagacgtacggtatcattgatatgaccgcttccataaggaaccgcctccgtcagcgttccctccatacggaacctgggagcaatgttttctttcactaaattcatatccattttatccattttcctacctcacttttattaataccggccgtatttactgcggccgtccccgttttgcagtttcattataacactattgtacaaaatttatttacacaataatttcggttttttatcttatcatggcgtttaccgtctattttaacaaatatttgttttcctgtcgtttttttctattatgtattccttaaggttttgcataattcatttcagaaaaagtcgtaatgcacaattttaattctggtttttgcacaatacatccaaatctttgcacaataataaaatcaattaaaaaaacgaaagaaaaaaggtgctttactacacaaaatttgttactatatatatcagatgataaagccgggatgtaggaaatgcacaaagggaaaagttcttttttattcccgtcccggaagtggaggatgatacaaatggagtcaaaaatcgttgataactacgaatccgtaaccttacatcaatctcttctgatcagcaaattgtttaccgttcattattttgaatatatgaatgacttttcctttccgggggaagcgcataatttctgggaatttctgtgtgtggacaagggggaagtggatgtggtggcaggaagccggagcctttccctgaaaaaggatgaaattatcttccataagcctaatgaattccacaccgtccgttccaatggaagggttgcgccaaatgtggtggtcatttcctttgaatgtacctctccttccatggatttttttaaggatcggattctcaccatcggggaggcggaacggagcctgatcgcgcagataatcatggaagcgcggcagctgttttcctgccctctggatgatccctacctgaaaaaaatggagcttgcggaaaatccgcccttcggctgcagccagatgatacagcttcatctggaacagcttctgatacagcttatccggcggcataccgcatcccggcaggaaaagaaacagccgtccaccctgaagcagaaatccgatggggatttatacgaacgcattatgaattatctggatcagaatctttatacccagatcacgattgaacagatctgcaaggataacctggtgggacgctctcagctgcagaagcttttccgtgaacgcaacggctgcggcatcatcgattatttctcccatatgaaaatcgatgcggcgaagcagctcatacggaaccagagcctgaattttacccagattgcagataccatgggctatacttcggttcattatttttccaggcagtttaagaaggtgacggggatgacgccgtcggaatattcttcttccattaagaaattatcagaagaaccgcagttcaggagataaacctgaactgcggttccttttattcgcccagaaccttttccagttctttgataacaatcttcagggccttgattctcgcatattttttatccacggattccaggatatgccacggcgcataggtcgtgctggttttctgtatcatttcattcacagccgcttcataggcatcccatttttcccggttcctccagtcttcatcggtgatcttccactgtttttccggtgtgttctgcctttcgttaaaacgttccagctgtgtttccttatcaatatgaacccagaatttgataaccacagcaccccagtccaccagctccttttcgaattcgtttatttcattataggctctctgccagtcgttggtactgcagaagccctcaatccgttccaccataacccttccgtaccatgtgcggtcaaaaatggctatatggccggttttaggcagccttgtccagaaacgccagagataatgccgggccttttcatggggctccgggctggcgatggggtggacttcaaagcccctgggatccagcgctccggtaatcctcttgatattccccccttttcctgcggcatcccagccttcataggcaataatcagaggaactcttttacggtaaagcctgttgtgaagctcacccagccttttctgaagcttatccagctcctcctggtattccgcttcctccatggttttgtccagagggatttcatcaagccttggcatcttctccagagggaaggtattctgcagcaggggaaccgccaggctcttgttctgaagggccacctcgattccctggcaaagggtctccaaaacctgcagctgcgcccatttacgtgaatgggcatccacaatataccagggcgcggttgatgcgttggtatcattcagatactggtcaaaaaccttcaggcatttatcataatgcttactctgccagcgatcggattcactcacccgccagcgggtatcttcgtttgataaaaggccgtccagacgttttttctgttccttttcttctatattaaaaaagaatttcattaccagatatccattatccgtaagctgcctttcgaaacgctttacactgtcaatccgggatgcatagcccttttcgtccagctttccccggagcacatcgccggtaatttcctccatccatccggaatccagaaatgtgaattttcccgcttcgggcagacgggcaaaatagcggtataaaaagggcttcctcaattcttcttccgtaggcgcggacatggtcgccaccttaaagaaacggggatcaatattccggatgattttaccgatcgtacttccttttccggcggctccccagccctccatcaggaccagcaccggaagggcccgctccttaatctgcatctgcagggcaaacaggtggtttctcgcatcctccagccgtctgagcaattcctcttcctgaggtttttcctgctccacgtgatttttcagcatagtgcctcctccctgatctcctgtacggaaatcttacggctttttatagtttttgcctgttcccgcgccgttattcaaaaagaaaacacttcctgacacgccggcgctttctaccttcagtgtagcatatggcgctcatggaaacaattcccttttaagtgctgggtggtgggtgtggataaaaattctgagtgagcggctccgtctgcccgggcgccccttccggtccttccagagggccagcggctcggtaaggttccttatagggcacgcttccgctcggacaaacacgcagcggtactaaggttgcaaaatacgcaacctaaggaccggcgtgtttatacggcccttacaggaatccttaccgagccgctggccctctggaaggaccggaaggggcgcccgggcagacggagccgctcactcagaatttttatccacacccttgaagacctttacttgttacaaatcacatccgccgggaagggcatccgcagagggaaggcacggcacgaaacacaagactgatgtgatttataatgtctactctattccttctttttccagcttcatgcttccgaagcagtacacgccggtatgtacgccccagatgatgcagatcaggataattggaaaattcccggttccgaacatcagttttcccagcagagccacggcttccatgatcggaagcatggacttcatgacctggaaggtgctgtaggaggctttataaataatcatgcgttccgcttcatcgcagctgtccatccagcgcttgttaaaattagtgtctcccacatcgccgtttttcagcggatggatctttttaatctgcttaatcaatactgcttccataatgatgatgcctgtacaaaatatcacaaacaggattacgcagaccagcatattgggatttttcatgtccatagccaggccgaacagcagaaactggatcaccatattaatttcattggctgatattgtaacattctgataatcgttggccttatcctcttcttcataggttccctgacggattgcggcccccgctttccggtaataaataaatgcgactgctcccaatacaacgaaaaagcctgcctggtacccaaatgagtactgtaaataaccattataaaagatatgcatgacatctgtcgtatccttcttgacagacataatcagaaatgaggtgaagaaaccgacagcgccgccaacaacaagccacagcactattttagccagaatctgtcccatactttttgatttattcttattatccttcatcgcccgctcctatctgccggtaattgccggctcttttatttctctgcgattttttcccttttttattcttcatatctgaaaatatcctccaccgtagtcccgcaaatagcggccagcttcagtgccagggtgactgagggtgaataatcccctctttcgatcaggctgatggtttgccttgatacaccggccatattaccaagctccgcctgatttactcccagtcttgcccggtgttccttcaatcggttatataacggcattatgacctcctttctcagcgtttccttatcatcccaggccttcgggatttcctgcaacgcaaaacaggatgacaacttttcttgtcaccctgataataacattgacaaacaaagttgtcaatgacaaatttacttgtcattatttttcctgcgggcactccggcatgcctgtccggctatctggtcagcttccggatccagttcccgtaatgggattccaggaaggccggcacacacttgaatatctgatccgcattcaggcagcataccaccaccgcaggagaagcctttaccacaaaggccataatgaaggacagagggattacaatcccccatatgctgatcaagtccatcttcaccacaaacatggcgtttccgccgccgcggataattccgttattggtcggcatctgataggacattcccacgattacgatgctcagtataatcaggaaggtattcgccatatctttggtagccggcgtcagatcataaatccgcagcagaggaacacggattacaaacaggacaagcccggataccacaccgattatcaaaaacagccgctgcatcagctttgcataatgcttgaccagatcgatatcccctgtcccaatggttttcccgataatgacggaagcggtggaagccgctcctaccgccatggacttgaccatcaggaagatggtagacgccacactgttggctgcaatcgccgccgcagtcatatggccgagaataacggtctgcaatgcggtattgactccccacagcccctgtaccagcagcatgggcgcggttaatttaaaataatccctgcacagaagcttgtccggatgaaaataatcactcagcctaagccgcagattggtttcctttttacggatatagaaaagcaataccagcagttctatggcccgggctgccagcgttcccaccgccgcgcctgccgcgcccatttccggagcgccgaaatggccgtaaatcagcacataattaatgccgcagttaatgaaaaaggtgatgatcgacagctgaaaggctatattcaccaattccacgctccgcatggtagcaagaaggatctgtgtgacggcaaagaagaaatatgtaaaacggatgatggccagataacggacgccttcctcaatgattgatttctccgttgtaaaaatgcccagcgtctgatagggaaaaatactgaccagcgtgaacaggatcaccgcgatcccgagccccgcccacatggctcccgcagcgatttttttcatgggttccgtccggcgctgtccccagtactggctgcagaatataacaagcccgtcccccagggccatcaggagctgctggtagatgaactggatctggttcaccgcagccacgccggacagagccgtctcgctgtaggcccccagcatcatattatccgccagattcacgcttaaggtcaccacgttctgaaggaccaggataacatatatagaaaaaaagttccggtaaaacaaggtgtctgttttctgtttcatatcattgaattccttcccgcagctttgctttcagccagtctgcattcacacctgaggcgctataatcgtttttactcccttgtcgccaaaccccgctgtcagttcctccggcgcatgccagtccgtgatcaggatatccacattctccggcgaggctatcaaaaccatggaatcatccccgaatttcgtatagtccagaagcatgatcttttctttggaaatggtcagtatctttcgtttcagttccgcttctcccagcgtgggcgtggaaaagcctctttccaccgtaaaatgattggcgctgataaagcctttgtcaaaaaacaggttccccagcacctgttcggccagatagcccacacaggaataaatgttggtgcgcagctcgcctccgattataatgctgtggatatccgccgctttcgcaagctccattgccacaaaaatattgttcgtacacggcataatattccgcttcggcccctccacaatcattctggcaagttcgaaggtagtcgtgccgctgtccagaaaaaccgcttccccatcctgaatgcagtcataggcagcggctgcgattgcctttttttcttccctgtggcggacctcattttcctgatgggaaaattcccgcagggaaccgtacctgctcaccgcgcctccccaggtacgcttcaacaccccttcctgctccatgttcgcaagaagcttacgcacagaaacctccgaaagtgaaaaagcctcgctcagctccgaaaccgatatggaagactttattttcagctgatccaagatatatttccgtcgttcgtcctgattcatattgcacccctttgccagccggaccggcatattctttttttactccaattatatacttccttgcgcacactctgcaactacctattgcttttttccttaattctttgcctgctcagcttttaaccgtccggacaggtctgaacgattacagtcactttcattttgcttacgattttatttcattttctatggacatcaaaaggcaaatatattataatgcaactgtaccttacagcaaacatatctgttcattttaataattcaggaggaatccctatgataattgacagtgccaaactaaacggcccctgttcctgcggcagaagccatgaaatgatcaccaaagaagccattatcgagcccggctgtctgaaaaaactggacttttatacggacaaatacggaattaccggaaaacgcgccgtaatttatgatgagaacacctatcatgccaaaaacatgctgcatcccgccgccgatcaggaaatcatcctggatcccacgaatttacatgccaacgaaatcgcagtgggaaaggttatggaacagctggacggtgatatcgattatctggttgccatcggaagcggtaccattcatgataccacccgctattgtgccaatgacagagggattccttttatctcctgccctactgcggccagcgtagacggcttctgctccaccgtatccgccatgacctggaagggctataaaaagaccatgcccggcgttgcgcccgtattcgtgctggcggatattgatatcataaaagaagctcccctgtatctggccctcagcggcgcaggcgatattttcggcaagtataccgccctggccgactggaatataggccatgctctcacaggagaatatctctgcccggtcattgaatccatgacccgggatgctgtggacgctgtccgctcctgctgcaccggcttgaaggaacaggatgagcatgccttcgaacagctgacctacgggcttattctttccggcctggccatgcagctgatggggaattcacgccccgcctccggttctgaacatcatatttcccatttgatagaaatgcagcctgcggccttccccttccattccgatgcgcttcacggggaaaaggtaggcgtgggaaccatactcatttcccaggcctgccacaaaatcgctgaaacagaagatatttccccttatgtccatccctattccatgcttccggaaaaagagctggaggagctgtatggcccgtccctgtatcccagcattatggaagagaacaaaaaggactgtatggaaggagtcactccggaaatgctcatcaatgcctggcctgaaatccggaaaatcatcgcaacaatcccccgcccggaggagcttaccgctttgtatgaagaaatcggggctaagaaaagcatggaggatatcgacgttccttccgcttatcttccccagctgctccgcttttctcccagcgcaaggaaccggctgaccatgatgcgcgtgtgctggatgctggatcttcctgagaacaaagcataactctgcctgcctaatcataaaaaaagataccgaagaacggtgccctgtcagcagacgaggtgccgttcttcggtatcttcttttcttttttcatttctgtcatgttctgtttcttttctaatctgcagcttttctttgcccggcggaaaaaaacggatgcctttcaaaaaatactaaagctcctccacccagcgtatggtttcccataccggttccccgtcgttatgctgttcaggccctggtgtgctccttccgcggaagatgtgtcctttcaggatttccctgagttctttttctatctccgggtattcttcgatcacattctttttctccccgatatccacggaaagatcatacagctggaacctgggcgctccggcgggttcttcccccggcttcggatccgaccaaccgccggatcccggacacatttccagcttgaattttccttttcgtatagaaagggaaccgtcaatactttgatggatcagatcctccctgacctctttcccctccggatccagccatagaggaaggctgctcacgctgtccactcccatttgcggctccagcgggatttccaggcaatccgccatggtcgccatgatatcactcaggcagaccgttcgggaacatctttttcccttcggcaccttttggggccactgtacaatcagaggaatgcggtgtcccccttcataaatatcggccttggtaccgcggaatacatagctgggattatgccccttcgccagaagctccggataatccgccatgggggaacagccgttatccgacgtatagatcaggatggtattttcataaagccccagctccttcagtttgcggttgattcttcccgccacatcatcacagtgcaggacaaaatccccatactcattcgtaccggattttccccggaactgctgtgccgggaggatgggggtatggggagccggcatgggaaaataaagaaagaacggttcctcacggtattcctctattttttccagtaccttatccgtcagctcatccaggaccttttcctgttcaaagcccggggccgtaggaccttcccggaaaaatccctttcccgtacccctggtcacatgatccggcagcgccgtaaaatgatcattttctatatagatatagggcggcatatccaaggaagcgctgatcccgtaaaagtattcgaatccataggaaaccggggaatcttctattttgcctgcataatccacatgatcgctggcatcgaagtccggtttttccacaaacccttcctcttttgcgaagctcatccccaaatgccattttccgaccatagccgtccggtagccgttatccttcagcatatccgccagtgtttttctcccccgttcaatcaggggttcggaatagcctcccattacagaggacttcagccgtgatctccagttataacgaccggtcagtatgccgtaacgggacggcgtacataccgcagcggtagcatgggcatcggtgaagcagatcccgttttccgccatttcatccagattcggcgttcggaatccgcagttttcattcagcgcggagatatccccgtagcccatatcatccgcaagtatatagatcagattcggtttagtcatgatcattcctcccaaaagtggaccggcccgcggccagcccactgtcattcaccataccttccggtatatgtggtcttaattgaagtttaactcctgttactgggtatccagcccgtagttattatcagcgctccactctttttccgctttgatggtatcgaataccgttttgaaggaatcctgcacatattgtgcaaatgcgtcggtatcataggttccttccagatacatctggccgccgcggcagaagaagtcacgaagctcgctgtttactcctgtgtaataagcaaggcggagcggttcctctgtgataataaagccggaaagcctgtcgggcagctgtgtgcttgtggaaaggggaatccggttgatgccttcggcaaatcttctctgtacatcgggagaggacataaactgtgcaaaatcaatggccgccgccagctttttggggtcggattcacatgctttatttacggcaaaaatgatatccggctgaccgccgagaataacggattttcccatggcgtttttattggtatccgttgtaattacgggaattgccataacgccgtattcaaagctgtcccccacatttgcggaaatggctgtcaggttggtggacatggcctgtaccatggcaacctcgccgcggataaacatatcaattgctgtcttctgatccaatccattgtaatcggaggtccagtactgggaaaaatctttcatcaggtcaaaagaatccttgatggaatccgaagtgaaatccagtgtcccttcgtcaaaagccttcaccatttcattcagctcgataaacccgtttccggatacgtctgttttttccaccaaatcattattcagctggctgcatacggaattgttgaaccacagccaggaaagatcgtccttggatgcattggggaacgcaaaaggagtcgttcccgcgcttttcagcttctggcagacatccataaactgatcccaggtttcaggcacctgcacccccgccgcatcaaataaggactggttgtagaaaatccttacaacgctggtggatgacggatagcccggcacatcattgtccgtcagatacattctctccagaatggaatccggaagagtttccttccatgccttgcctgtatcataggggctttcctgatcatataaatccttgaagttatgcagatagcccgcttcataatccgcagtgatatcataaataattccggtatacacatcagggccctggttggcggtaaactgtgtggtcagccatacccggtaatcggtaggctgcttttcgaacttcacagtcgcgccggtctttgtttcccattccttaataatttcttcggataaggcgttcgccgtttcatccgttgataaatcctgagcgaatacaagcgtcaccccggaaaagtccgtatcgccggcagaggcctcttccccgcccgtttccgccgctgcaggagcctgtgattccccgccgcccgctgaggattccgccggagccgccggcttctgtgaactgccgcagcctgcaagcatacaaacagacagtgcgattgccgccaatgctttcattctctttttcatgtttttttcctccttagaataaaaatactgctttttcctattgttgccttttcctattgctgctctttccgctgccgcagcagcggcatgaaactcaacttttttattcctccccttatcccttaacggctccctgcgtaattcctgccacaaaatatttgctggcaaaacagaacaggatcaccagaggaagagatgcgataatataacctgcaaacaacaccccgtttccgtccgataccgatacaatcagcttggtcagcgccaccgcaatctgctgtgtcgcttcgccggagctggcgaccagaggccagatataattgttccatgcattcagccccgtcatgatggtcacggtggacagtatcggtttggacaggggaagaaccaccttcagcagaatgtccatatccccggccccttcgatttccgccgcttcaaacaggcttttggaaatagcctccatggagctacgcgtcaggaacgtccccatcgccacctgataagcggcgggcggcagaatcagcccccagtaggaattgaacagccccagattcgttatctgtacaaactgcggtatcagcatgacgaagcccggtatcataagcaaagcgatgattccataatagagaagctcttttccgaaaaaactctcataacggacaaaggcgtagctggccagcatggaaaccaccaccgttatcaaaataaccgcaaaggttaccagcagggaattcagcatgggccggaccacctggggcagcgccttggcataattcataaactgccagttcacggccagctgaaagggtgttttaattatttcggtctgccctttaaaagaattaataaccaacagataaaagggggccagtgtgagcaataaaaggatgcccaacaagatacggctgaaaatactgactgcttttctcatttccgtgcacctcccctaatccatgctttccgtatttttcataagcttctggttaattaccgttagtaccataataattgcgaacatgataacgccgattgcggaggcgtatcccattttccggtaggtaaagccctgctcgtaaagcaccaccgacggtgtgatggtagccgttcccggacctccctttgtcaggatataaaccgtatcaaaaacctggaccgcattgatgatggcaagggtcaccgtcagcttcatctggcttgccagcatggggaggtcgattttgataaaccgctggaagatattagccccgtcaatttccgccgcctcaaacatatctttggatatgttctgcagcgccccgaagtaaagcaagaactgaaggccgcccagagaagcgcttcccagccagggaaaaccgattgcgatgatggaaccgagcgccgtcctgctgtcccccagccagggttttgccagatttcccagtccgatggaggtgagtatattgttcagcacccccgtatcccctgccaggatccacttccacagcaggatgattaccacactgggaacgaccatgggaaaggtaaatgccgtcctgaccacatattgttttttcgtggatttcaccgcatacagcagctctgccgccagcagcgggaaggtcaggacaatgaggatatccgctccggcgatccagaggctgttcaccagggatttggtaaaagtgatatcccggaatgccgctatgtaattatccagccccacaaaaagattaacgtttgccccgttccagttaaaaaaggactttatgatcgccattccaaaaggaatatacttgaaggtaaccatcagaagataaataggcagaaggaaaagatacggcttcaccatcctgaacagagacttctttttcatcgccgccgcgttatccctctgcagtccgccggcatttccttttttcatcgttcatccctccctatagcaacagatgtataacatattcagccaatgtcattttttatcgtttgttttatctgatatatctattctatagagattttctttataaatcagtgggttatttttatattttacgtgtaatatttttaacttctttatatattttgcactacactggtaattttgtctcatacgcagcaacggacatcccgcaccgcaggacgtccgtttttcccgtaaaaaaagacttattcccggataaaccgtcactcattctgtttccgttttactttcatcaccacccggcagccgcctccttcagcaggaaagagtgtcagaccgtattccgggccgtccgatagcttaatgcggttgttcacgtttttcagggccaccccggatcccttctccgaatccgcagcttcataattgacttcggacagctgcgcattcagctccctgctcttatccggcgtaattcccactccgtcgtccgtaacggtcacgataagcgcctcctcccggacttcggcatcgattcggatgatcccccggtgcccgtctttgggcagaactccgtggctccatgcgttttccacaagaggctgcagtgtcagcttcagaatgctcacctgcagaagcggcgcttccacgcagcattccagggtaatactgtcatcgaaacgcatatttattatacttacataggccttaacatgctcgatttcctttgccagcggcaccctgtggtttttcatatcacagctgtaccgcatcatattcgacaggttttccgtcagcaggacaatggaatccacctcttctatctgggcgatacagtatatattatccagggtattatacaggaaatgagggtttatctgggactgcagggcagaaagctgggcctccttttcctgtaccctgctcagatacatattagcgctcatttcctgaagctttctcttcatctgattgaaacgattccctatctgccccagctcgtcattgctttttacctggataaaggtgtcattttcttcctctattgtactgataagcttattcagcagcgtgataggcatcatgatccggctgctgaaaacaacggtcagagccatggccgctataccggttcccagaatgataagattaatattccggataatccggttcatatcccggaaggtatcctgggtggattccaccgaataaatatgccatccgaactgatcgttagttacgccgtccacaaaccactcccggttcaggaaggtgcctgtcctccccaaatcctccctgtggttttcgatgaggaaggcaacctcctcctcctgggcctgcgtcaggttaatgcctgccagcacattttcctccctatcggaaataagatatcccctggagttctgcgcatattccccgaaaatatcccggatataatccatatttatgctgaacaggataaacggcttttcctcctgcctgaagccgctggaggaaggcacattccaggccctcatataataaatagcctcattttttgttatattttccggcctgaaatcctccgtaagaggcccgtacatcagcttcagactgccgctttgtcggaatttccaataccagtccgcctcctgaaaagaaaagtttttctgtatgggcccgcttcccacataggcatttttatcttcgtttatataaaaaatgaccccggtgaccacagactgcatattgttgccgtttatggtttccttcacctcatgctcataatccagccgctgcttcatctgctcaaaatcactcagatggggctggtaacggaacatttcatacagctgttcattattaaaggttataaaaatctgattcaccttatcataaaggccgttcagctcatagttgatttccttcatctgctgagaattgtactgctccagaagcccgctgataaaattatggttataatagttaatggacagcgtcgtccccagcatagccaccagcaggacaaggccgaatgaaagtatcagcctggtgcgcatccccagcttttcaagtatccgttccatcctcatcctctatctctctggcaatccccgctttatattctcccggcgtcaccccgctgattttcttaaacaccttggtaaaatactggtaatcatcatacccgaccgcttcggcaatctgcaccagcttatattcggtggatgcgatcagctcctgcgctttttccaccctcacctgagccagatagctcatgagggattttccggacacctttttgaacaggctggaaaaataggactccgtcacatggcattcctccgccaactggctgagcgtataatgtctggcgcagtcctcccggatatcccgcatcagcttttccacgatacgggaagaagaattatcctcagccatcaccgccagacgttcttccagcacatctgcgcccgctttttccccctccgcctgctgcctttccgcttctatctgctgcacacactgatccagaatcaggttcagctgctccctgctcaccggcttcagaaggtaatccaccgcacggaacctgagcgcccttctggcattatcaaaatcatcataggcagatatcatcacgatctttgcattgggattcatctcaaaaatccgttcacccagatcgcagccgttctcctggggaaacatcacgtcggaaaggataatttccggcatctcccgccggaaaatttccagcgcctgcgtcacattttccgcttcccatatctccccgataggattcctctccctgtcaatcatccggacaatccctttacggatccacctctcatcgtccgctaccagtactttaatcatataactcctttcccccgataaagctctttccttcccctccggcagcggagcctgtccgccgccgcttataaacagcttatcatctgccgtattttaccgtcaatcgattcctgtacttatttctaattgcactatgactaggaattatcattttcattaatatctaacccctctaattctgccgcctcaaagattcgttgatttaaccagtcactttccggtttacatacaagtcttgcattagaatatgcaaccggcaatgttaaaattgtaggtgccgtatatttttttgaggtactgttatactctactaccaatgcaacctctgctattctttttgtattaaatgcaagaggtaataatatagacattttattgtaggaaggaaaatatacaggtatcgctgttctatagttccagcttacacgcatcactgtttttcttacagcactacggaaagccgattccaagtcatcatagacatccgggtctgacgtgatttcatcgccaattttatgccagtattctttcttttctttttctgtaaaattgtttatatctatatttaacaactctgtaagtttagaagattttctgcatccatccaccaaaaaacagtgtggcagcctatccggatgatctataaaataatggtcaggctgcaaatccggaacttgttcgtctggtgttttctcttctgatataatataacttatatcggaaatcttggaaaaataacggaccggtttgggtaatctgttaaagttatctgccagcaatcgtcctccatgcttaatcccaggtatacaaaacataacaaatttccaaggtttcaatcctatatttttttcgaacaatatatatatgtattgataatttctattaaccagccctgtattgaaaacggaataacgtccatcaatacttaacaatatcagtttatcctgccaggcttttgcgaatgtatagttaatataacttttaaggattggaaaatcgtcatcacttggattttccttaaaagaccaattttcgtataaagccaattcatctttcaattgtttcagatcagctaaataattattccattgggcataattaaaaagcatttcccgtggtttatttccaacttccacaaaaatgtcactatgaaactcatttgcagaaattgctccctgcatctcccaaggctgtctgttttcattcttgttagggacaaaaatgaaaacgacagcacttccatcttcttttgaaagaacatccactgtcatataaatatgatcagcggatgttaaatcgctgacaacaacattcccatttttataaataatttgggcctgttctatttcagaagctgcttttttatataaactattaattatttgcagaagttcatattgtgttgacttcgtatttccacttaaaatacgaaaagataccaaagcacgttcaggaaggaacgcgaaatcttttatttctttaaattgatcaataagcatacgaaacctctccttactattttttataatacaaagcggcaaaaaatacttaaaataaataaaaatcgaattgacatatatactatattgtgctatgttatagatgtctagtggatataatttttttgtgagtgagtccttgttctgtagtgtgatacagaacagggactttttattatccatactattattcaaataccgaaatgaacaacaccgcttcgatgcatacttttataacttatataattattaggatcgtgaatttgtgcagaaactgccagatagtgtaaatacactaaatttagtaataagattataattaagatactttataattgataatttgtcaacacttatataataaaattatttgtccgtaagttcatcgtaatttggaaaattacccatgattatagatcaatatttcaacctttgacagttaaggaaacaaaaaaccgctgtaagccttgaaaatcaggcttacagcggttccactaagtttttgcaaagtatagcaatttattttcttcttttacttcttttacaaggcaccgcacacttttccttattcactcacggattcaggaatgttacagatatagtccggcaattccctccgcgaagccagccagtctgctttactcatctcataatttacaattgagttccattctcccagttgatcctgccatgcatctgtttctatccccacacgtctgaaccccagctttttttcataaacatgctgcgcccgctcgtttttcaggttcgtgtccagaatcattttctcatatccataataacagaacagcgcatcaataaaaacagtaagcaattctgtaccataccccttttcctgcctggtaaagtcacagattttgataccgagttctgccgccccttccttattacgataattcatttcaccaataggggtaccgtcaagttctatgatatgccgacggtggctttcatccctgtcggaagcaaggctctcacgtatttcttccggtgtacatcccacaccattcggaaagcccgcatgagccataacctttccgtcattccaccatgcacagagttgttcggcatcggcggacaccgcattgcgaatggttaagtttttgtatctgataaacatacaagtcctctttatttcccaatcaccttaggattctccgccctcttcggcagaaccaccttatccagatgccagatatcattcacatactcctgtatagtcctgtcggagctgaactttccggagcatgccacattcaggatagcgctctttgcccagcctgcctcgtcgatgtaagcggcctctaccttgcgctgcgcttccgcataaggcttgaaatccttcaggataaaatacatatccgctttggaggtactctgtgtattcagcagggagttgtacagcgggcggaacagttccgtatcataaggagcaaaggttccgttgatcagctgcataagtactttgcggatatccggatcgttattgaagatatccatgggattataaccgccgaaattctcaaaccggattacctcatccgagcttaacccgaaaataaaggcgttatccattcccacttcttccacgatttccacattggccccgtccatggttcccagggtaagggctccgttgagcatgaatttcatgtttccggttccggaggcttccttgctggctgtggaaatctgttcggacacatccgccgccgcgaaaatccattccgcattggaaaccttataatcttcaataaataccaccttgattttgccgccgatggaagggtcattattcaccacatccgccaccgcgttgatcagtttgatggtcagcttggcattcctgtagccggcagccgctttagcgccgaatataaaggttctgggataaaattctttatccggattttctttcagtccattatacagatacataatgtggaggatgttcagcagctggcgcttatactcatgaagacgcttcacctgtacgtcaaaaatagaacggggatccacttccacaccgttatgctccagaatgtaattggcaaggcgcactttattctgatacttgatattcatgaactcctgctgcgcttttttatcctcggcatagatcttaaggccgctgatttttgataaatcggtaatccagtcactgcccacatgagccgtaacccactgagccagaagagggtttccatgaaggaggaaccttctctgggtaataccgtttgttttattattgaatttatcgggcatcatttcatagaaatccttcagctcctgtttctccaggatttccgtatgaagccttgcaacgccgttgactgaatagccggaaacgatggcaagatgcgccattttcacctgtccgtcataaataatagccattttggcaatcttgttctggttgccggggtacatctgggaaacctgcgccacaaaacggcggttgatttcctcaacaatctggtaaatacggggaagaagtctggagaaaagttcaatcggccatttttccagggcttccgccataatggtatggttggtatacgcacaggttttggtggtcacagcccaggcttcatcccaggtgagataataatcatccataaggatacgcatgagttccgcaatagctaccgtaggatgggtatcattgagctggaacgtcaccttctcgtggaatttgcggatatcgtcatgctttctcatatatttttccaccgcttcctgtacggaggcagaaatgaagaaatactgctgcttcagacgaagctccttgcctgcataatggttatcgttgggataaagcacctcaacgatattccttgccaggttttcctgctctacggccttctggtaatcccctttatcaaaggattccagctggaagcattccacaggctccgcatcccagatgcgcagagtattcacaataccgtttccatagcctacgataggcatatcatagggaacagcctttacggactgatagccctcctgcttaaagcagttgcgtccgttttcatccacaaaaacattaacatatccgccgaacttgacctccttggcatattccggacggcggagttcaaagggattgccgtcggccagccagttgtccggcacctcaatctgatagccgtccctgatttcctgtttgaacattccgtagcggtatctgatcccgcatccataagccgcatagcccagggttgccagggaatccaggaaacaagccgccagacgtcccagtccgccgttgcccagcgccggatccggttcctgatcttccactgtattgatatcgattcccagctcttcaagagcttcctccacatcctcataagcctgcagattaatcaggttatttcccaatgcacggcccatcagaaattccatggaaagataatatacagttttcggatcctccttctgatactccttctgggtattcatccaattatctacgatgatatccttgatggcataggaaaccgcctggaaaatctgttgctgcgtagcctcctccagggttttcctgtaaagggtctttacattatacaccacactgttcttgaataaatctttgtcaaatttctgaataaccggtttcttaagcatttactttctcctcgttcctcacaattatcgttcattttacggttcatacagcgatgcaggaaccgttctttcctatactatattatgcctgctgtaagtctgacacgtacagtttacaacactttaccaaatatggaaacagtaattttgtaacaataagttataaattcagtaaaaaaagccgccacttcacaccaaagcggcggctctctgtcagaaaaacgctgatcagttcactttttcgatagcgatggtcacattttcaccgttaacgttccattccttgcttacagccagcatatctcctgccgtaatggaatccgcaagcaccttgcctgcaatgaattcctggttggaggaagcgatccccgctacggtctcatttccgcacagagatacccggatgtgatccattacctcaaaaccagcttccttacgcattgtctggattttactgatgatttcaaatacaaagccttcctcaatgagctcatcggacaggttggtatccagaactaccgtcatattattgtcgacctcggatacatagccttccttctgtgtcatttcgataagaaggtcttccttggtcaggcttacttccacgccgtttacgtcaaaggacaggcttcctgaagcattcaattcatccatagcggcatttccgtccagagcggccagagtcttctggattccgcccagctgtttgccgtatttcggcccaaccgtacgaagctgaggcttgaaggtataggtggtgaagtctcttacatcgtcagtgaataccactttcttcacattcagctcatcctctacgatttccttatagaaatcgctcagggtgtttccggcctttacaaacatggtgccgataggctggcggttctttatatttgccgtatttctgcaggcacggcccataacgacgatatccagcacctcttccatcgcttcttccagttctttatccacaaaggcgggatccgctttggggaaatcgcacagatgcacgctttccggcgcatttttatccaggcttctcaccaggttcaggtagatttcttccgtcataaaaggaatcatgggcgcagccagcttgctcacggttaccagggcggtatacagagtcatataagcattgatcttatcctgctccattcccttggcccagaaacgctcgcggcttcttcttacataccagttgctgcagtcatccacaaaatcctgaagggctcttgccgcttccggaatctgataagcgtccagacgggtatccacttccgtgataagggtattcagacggcttaacagccatttatccagcacggacagcttgtcagcttccagcttatattttgtggcgtcaaaattatcaatattggcatacagcacgaagaacgcataggtattccaaagggttcccatgaatttgcgctgtccttcaattaccgccttgccgtggaaacggctgggcagccagggagcgctgctggaatagaaataccagcggatagcatccgcaccgtattcatttaaagcgtcgaagggatcgattgcatttcccttggacttactcatcttctggccgttctcatcctgtacaagtcccaggacaattacattttcaaaggaagtctggtcaaagagcagagtggattccgccaggagggaataaaaccatccgcgggtctgatccacagcctctgaaataaactgggcagggaactgctgctcaaaggtttccttattttcaaaaggataatgatgctgtgcgaaaggcatggccccggaatcaaaccagcagtcaatcacttccggcacacgcttcatgggctttccgcatttcgggcaggggatggtgatggcatcgatatacgggcgatgcagctccaccgtcttcgcttccggattgccgcttaaactctccagctcttcacggcttcctacggaaagcatttccccgcagtcacactgccagatattcaggggagttccccaatacctgtttctggacaggccccagtcctggatattttccagccagtctccgaaacggcccttaccgatggattccgggatccagttgatggtattattgttagcgatcagatgctcttttaccgccgtcattttgataaaccaggattccctcgcatagtagatcagcggcgtatcgcatctccagcagaagggatagctgtgttcgaatttaggagcggaaaacagcaggtctgctgccgccagttctttcaggataataggatccgcatccttacagaaggttcccgcccagggcgtttctttcgtcatctcccctttgccgtccaccagctggacaaagggcagatcgtaattgcgtcccacattggcatcatcttcaccgaaggccggagcgatatgaaccacaccggtaccgtctgtcagtgtaacataattgtcacaggtcacataaaaagcttttttatgctgtttttcacaggtttccaccgcacagtcaaacagcggttcgtattccttatattccaaatccttacccacataggtttccagcacttcataagccggaacttcagggttttccttgttcaaatcacccagaaccgtatccagcagcgcctgtgccatatagtaggtaaatccgtcggcggcctttgccttaacataggtttctttggggttcacacaaagagccacgttggaaggcagtgtccagggtgtggttgtccaagccaggatataagcatcctcgccctttaccttgaagcgggcgatagcggagcgttccttcacatccttgtagccctgggccacctcatgggaagacagaggggttccgcagcgggggcaatagggaacaatcttaaagcccttgtaaagcaggcctttatcccagattttcttcagcgcccaccattcggactcaatatactcatcatgataggttacgtaggggtcatccatatccgcccagaaaccaacctttctggagaaatcttcccacatgcccttatatttccatacgctttccttacatttctcgatgaaaggggcgattccgtactcttcaatctgctccttgccgtccaggcccagaagcttctccacctccagctccaccggaagcccatgggtgtcccatccggccttcctgggaaccatatatcccttcatggtgcggtaacggggaatcatatccttgatagcccgggtttccacatgacctatatggggcttgccgtttgcggtcggcggcccgtcataaaacgtataggtaggggatccctccctgattttcatgctcttttcaaagattttccggtcttcccagaatttttccacttcgtgttcccgttccacaaagttcagatctgtgtttaccttagtgtaaagtgacatttccttcttcctttctttctccggcattcagcctaaaacctttccataggaacaaaaaaccccgtccttgtaaaaggacgaggttcaagactcgttataccacctgttacagcatacggctcataaaaacaggaacctcaaaaagcggactgtctttataagaatatatggtttcccgtaacggaggaaatccggcgttgcctacttgttccctttcagcccgcagctaagaagtgatcttcctcatgttttactcgtaccggtctcccacctgcaccggctcgctgcacctttccaacatgactactgtcttcctcatggctttttcctgtgttcatgtcggtattatatagcccggaaagccgcattgtcaagggattgtgggaaagaatccatgggaattgcttcaattattgaaaaattattttcaatgccagtcgaattgtgttatattctgtttgtatacaatcctgaaaggaggctgttcatgggctggataaaagcatatgtaacaaaaatataccgaaatatggggcaatatctgcgatggctttttttcagcggactgacaggagcggccgtggggctgtttgcctctctcttttcctggtgccttaaccacgcaaccgctttccgcacacagcatcactacatgtttctcacactgccgctgggcggactgctgattgtatttttatataaagcattccattatgaaaataacggcggaaccgattccgtaatcgaaagcatccacagtgaaattatcatcccgttccgcatggcttttcttattttctgttccacgattatcaccattctctgcggcggctccgtgggccgggagggtgcggcgctgcagatcggcggcagcatggggaaaaagctgggggatatattccattttaatgaaacagataagaaaatcattctcatgagcggtatggccgccgctttttccgctctgttcggcacgcccatggcggctgctttttttgccatggaggtttccagcgtggggatcatgtactatgcggcgctggttcccagcatctgtgcggccctggttgccaatgatgtcgccaaatacataggcgtgcagacagaaaattttcatgttatgaatgatctggagctttcccttgttcccgggctgaaggttgtcctattggcggcctgctgcgccatgctgagcattcttttctgcatgatgcttcagatgggggagatttttttcaagaaatattttagtaacctgtatatccggatctgcgcgggcggcatcctactcattctcctcaccctccttatcgggagccaggattaccttggaacgggcatgccgatcattgaacaggcgctggcaggcaatgcgctgccatgggcttttcttttcaaaatgatatttacggtcatcacgatttccgccggctataagggcggtgaaatcgtaccctccctgttcatcggtgccaccttcggctgtactgtcggcgcccttctggggcttcctgcatcactgggggcggcggtaggcatgatcgccgtgttctgcggcgtcaccaactgtcccattacctccgtgctcatttccttcgaactgttcggctttgacgatgcctattattttctcatcgccgcagccaccagctatatgctctccggttactacagcctgtatcacagccagaccattgtttactccaaatttgagaataaatatgtaaaccagcatacaagcaggcctttttaaactgctgctgcggcggttcgggcagacaggaaccgttacacgagactcttaaacaggaaaaacttgctttctttcttaattacgcgtattatattggtatttataataataattttatccaggctttacacgccgtccggctgtgtaaagcctgaactataatgaaagcggaggagcacccatgaaaacgcggaatcttaccctcatgaccgatctctatgaactgacaatgatgcagggctacttcaaaaacatggatcgcaatgaaacggttatttttgatgctttttaccggaacaatccgatggaatccggctatgccatctgtgccggcctgcagcaggtcattgaatatgtggaaaatcttcattttgatgacgatgagcttgcctatctgaaaagcctcggcatctttgaagatgccttcctggaatacctgaaggatttcaaattttccggcagtatctatgctatccctgagggaagcatcatgttccccagagagcctatgattaaggttatcgctcccattatggaagcacagctgatcgagacggctattctgaatatcatcaaccaccagagcctgatcgccaccaagacctcccgtgtatgctatgccgcccgcggagacggaatcatggaattcggactccgccgtgcccagggccctgacgcagggatttacggcgcaagagcggctatgatcggcggctgtaccggcaccagcaatgtcctggccggacagctttttgatgttccggtaaagggaacccatgcgcacagctggattatgagcttcccggatgaatataccgcctttaaagtatatgcggatatgtatccgggcgcgtgcattctgctggttgatacttatgatactttaaaatccggcgttcccaatgccatccgcgttttcaccgaaatgcgggaggccggtatccccctcaccttctacggaatccgcctggacagcggcgaccttgcatatctttccaagaaagcgagaaaaatgttggatgaggcaggttttaccgatgcggtcatttccgcttccaatgatttggatgagtacctcattgacagcctgaaggtacagggctgcaaggttacctcctggggcgtgggcactcatatgatcacttccaaaaactggccttccttcggcggtgtatacaagctggccgccattatggataaggacggaaactttgttcccaaaattaagctttcggaaaattccgaaaaaattactaacccgggcaataaggttatttaccggatctatgaaaaggaaaccggtaaaataaaagccgacctcatcgctcttgccgacgaagaattcagcgaagacgaacctctgctcctctttgatcccctggagccctggaaaaagactttgctggaagccggtacttataccattcgcgatcttatggttcccgtattcctggatggaaaatgtgtatacacttctcccagcgtaatggaaatcagagagtactgtcagaaggaactgaataccctctgggatgaaacaagacgtcttgtgaaccctcatcaggtatatgtagacctttcctccaagctgtatcatatcaaaatccagcttctggatcagatgggccaggtgcactgaccaaaatccggagccgacaaggagaatctatgctgaaaataattaccgactccgcatctgatttatcggaggaactgatcagccgatatcagctgcatgtcatccccacacccgtcgttattgacgaagtggattatctggatgggaaaaccattcagaccggggaattttacaaaatactggatgatacaagcagagatgtgagaacctatcacatcaaccctgccatgtttgaagaagcctttatgccctatgcaaaaaatggtgacagcgttatctatctgtgcttttccacaggaatcgcaggcaccttcaacgccgccaatattgcaagggacagtatcctggaagaatatcctgattttgatctgacaatcattgattccaggtgtgcctccgcaggcttcggccttctggtcgtcaagctgctcactatgctggaacacggcgcatccagggaaacactgatagaggcggccgcatactatcgcagccatatccgccatgtctttaccgtgaataccctcgcctatctcataaaaggcggaaggctttccaaatttaaaggcaatctcgccgaggcgctggatatgaaaccggttttaatcgtggatgaagccggaagcctgcaggtattaaaaaccgtccgcgggcataagaagtctctgaaaagcctggtggaatacgcggaagaaaacggcgcggagctggaaaaacagcttgtgtccgtctgtcatggtgaagacggggaagccctgcgctttgtaactgatttgataaaagaaagactgcatcccgcagatattatggtatcggtagtgggctgtgccatcggtgcacataccggacgagggattataggggtatgcttcctggatgccccggaggatccttacatggagtatctttcctgatatttttctcatatccgccttacggcaggaaccacagcccggccgcaatcagataaacagcggaataatacagggccagcagtaccgctccggaaagccggttgtttttttcatgcagaatccggaaccccaggatattatctgaaatataaaaacagatcccccctgccgccatcagttttcccgccgggctttccgattgtaccgcaacggtaaatgccatcgctgtcataaaggacagaagcgctccataccccaccagataaatggcctggctgccaaagttaggaagaaatttcccgtgaagcagaagcatgactgtcagcagcagcaaaaaaagaattaccgtcatcaggcgtaccggggcgaggtgaatataggctgtcagaaaacatacatgccccagcgcaaaagccgctaccccggccaggaaaaccagttccagcagcacatccgccgtcatgcataaaaaagcgcctgccagaatcagcagggatacaaaccgtccctgctctcccgccctcaatgtatataagagggccacggctacgggcatacatgtggccagtgctttaaataaaagtttctttttccggaaatagtactggccaaacgcagccgtcagtactgccgccgctataagtataaatattctctgcagattcataggcagcctccattttttctgaggctgcctatgtatttcttccatagcactgcctctgttctcttcatcataactcaaatttcagaatttttccatgattatcagccgctgaatttctccgtccgtatatgatatttttccggtattcgaagatattcttattctgtatctgccgtgatgcctgatattgttttttatttgtagttgcgtattgaatacccatcagattattgctatcataattccgtaagataaaaacttataattccggtttttcagctgttttaggtaatgtacatcatccgccgcatatgcgtctgaaaaagataggagcactatgaagaaaaaacgtactattatattcctgtgtatcattctgctgcttgccgcagcgttctgcctgacagccttccgggttcgcggcagcgtttccgtaaagggggacggaagcaccccgtctccggatcctgttttcttttctcaaaaagatcctctctgggccggagatttgctgggagactcctcctttaccatggaaacctccggatgcctgaccgcctgccttgcggcggagcttcgtatgcaggacatttccataccggaaataaacgccatggatccgggtaccctgaattctttcttttccgggaaacaggtctatgacaaggaagggaatatccaatgggatcccctttcttccgccctgaatgtatccctggaaaggataaacggtatttccgcaatgaggaaaaccgatctgacggcccttttatcggaagggatttatcccattgtgcgtgtccgtgtaaaaggactgggaaattttcattatgtccttctggtcaaatgccaggacggacagttctggtgcatggatccccttcatttagaagaggagcttgttccgctgtcagacttcgggaaccgtatctatgccatccgttatctgtaccgctcctgatcctgttcggctccattaaaaacagccatccggttaccgggcgtcataacgccctgccggatggcttttctctttttcgtatttattccgctgcgatcagttcttccagcatttgctttgccgccagaatatctctcttctgctcttccccggagatttccctttcaatggttatatcgccgtcatagcctatttccttaagctttctgataaaagcggggtaattaacctttccctggcccaggggcttctcttctcccagttcatagccatttgtgggatagcatccgtcctttccatggatgcccatcacatattccccaaacacatccagggaatccaccggattgcctttcccgtacatcagaaggtttgccggatccagatttattcccacattccccgttccaatatcctgaatcgctcttttcagcgtcaccggagtctcctgaccggtttcaaaaaggaagttctgcccgttattcttacatcgaagcgcaagctccttcaggcaggctatcacactgtgataattggggtcatacggattctccggcatataacccacatgggtcaccagattatccactcccagcagacgggcgaaatccgagccctccagcagcatttcaagccgccggaaacggaatgcctgaggcaccagtcccagcgtctcctgtccctcataaaaattccataccttcggcccttcccagccgcaccagaacgctgtgatttctatccccttttcccggacggcctccctgacaacagccgccgtttcctcattcagaaggctcctgtcccagcagacaagctggcagctttccacccccatttccttcagttctccgaatttttcttttaagtccatatccgcgtgtaaatttactaaaatacctactctcatattcgctcccatctgtgcatcttccctctgtttcggtccatgcagctgaaaatcaccttttattgtccgtattcctttatatacttctttcccgcttcccattcttcaattcccagaaggactgacttaatcccctcttccagaggcgctctggtgatctcccgatcctctgccaggcattcataaaaatacttgatttccgtataataaggccccaaatcagatatgttgattccggcggattcatcatgaaggctgatttcctcctgcagtttggggacagaaatctctccgcccttatgatatacctgcacagtcggcgtctgcctgccctgataaattatggtggcttcttcaaagcacgcccggaaagagccttcaaagggaagctccgtacatacgtcccagattccttctgcggttgcaaatacactgccgaactgataggaggtgatgatctggtttatcattcctccgggaaaagccgccgccttcaccgtgaaggaatccggttctcccagcatataccgcagaaaatccaaatcatggatatgcagatccagcacaacgctgccgctttttctttcctcatggaaccagtcctcatacccccacttggtatccccgctgattctctgcattacgatggatttcagctttccataagtctttttttcataaatatctttcagataacggtactctccgaaggaacggaccacctggcccaccataaccctcgctccggttttcttctgtacctccaaaagcctgctgcagtcctccctggtaaggcacaccggcttttccagaaagacatccatccccttctccattgccgcaatcgcatgctcggcatgaagatagctgggcagacagatatgaaccgcatccagttcttcctcccttaacagctccatccccgtagtataggtctttgcccccggccactgcttcgccgctctttccagaaattcctgtctgcagtctgccagagccgtcacctccacatccattttaccggataaggcctttaaagacaggttatgagtcgtacccatgcccccgcatccgattaatccgatcttcatacataatcccctttccttcactttatgttttttattctttttttaattaatactatcatcttacaaattcacaataccatcggacgcttctcttgtcaatccttctgttttcattcttttattctctattttttgagactgaaagcctgtatttttccttttttccatattgagcttttcctgttgttatgatacactttcaattagttctatgatattacaattctttatacacaggggtttttatgaaattagtgaatcaacagcttattaaaaatacaaacttgaagctgctctataactcagtttttaaaaatcgggggatttcccgggcggccctggccagacagaccggcctgagccggacggccgtttccgcgctgatcgatgaattatcggacagaggctttctctttgattccggaacgggagacagttcaggcgccggcaggaagccaacctgtctggagctttgcgccgggaattatttcgtggcggtattcggctgggaggaaagctccgtccatgcttttctcatcgatatctgcggcaccacctccatgcagatgcggctggacaaagctccttccgattcctacgcccaaatctgccgtacctttctcatggatcagatactggaacaaatccggcccgaacagcttctgggactgtgctttgttcttcctgccatgatcgatccggaaaaggaagaggtattctccaccaccttttcccttgcgggcgatcagggggaagcgggagtcatcccctgtctgcgctccctttttccggattatgcagtggccgtcctcaatgacacggcatgctgcgcctatgcggaaaaaatatataccggcatccgggaaaaagattacgcctttatccggttcagccgcgggataggcgcatccctgttcatacaggataagcttctcggacaggcctgtgcgtcttatacccaattcggacatttcagcatttcccctgaaggccctccctgtccctgcggcagccggggctgcctggaggtagttctcagtgaatccacgctcaaagggcggcttcaggcaaaggggactgcctcctccctgctttccatggatactgtccgttatgaagacttgggaagggccgccctgtacggggatactgccgccgtccaggtcatccgggatctcgccggggaattttcctttgccctgtccaacctcatctgtctggtgcatcccagattgattgtcctcggcggaaattccgtttccctgggctccgtatttcttgaggaaatacgccggagcctgtccgaaacaagctttgcacggatgacggaaaatgtaaaattgcgttacagccagctggattcctatgcctgctataacggcgccatgaaatacttttttgaccatcattatcaatttacggaacccatggaaggctcgttttttatcggctgaatgcctgtcccgtatcagaaaagaggtttattatgagaaaattaagaatcgccctcatgggctgcggaaggatttccgccagctatgcccttgtctttccccgcctttcggatatcgccgaatttgtctgcgccattgatatcgaagaagagaaggcaagggcctttgccgctcctttcggcgctgcctggggtacccgttttgaggatctttcagacaaaaatattgatatcgtccatttatgcctgcctcactatctccatgctcctgccgccatacgggctatggaagcaggcatgcatgtccttacggaaaaaccggtctccatcaccctgcaggatgccgacagaatgaaagcggtttccgagaggacaggaaaaaaactgggtgtgattttccagacccgttatgaagaaagcgtacagcagctgcgccgcatgatacaggacggcgctttcggccatatcttaagcgcccgttccatcctcacctggtcccgcccgtattcctattatgaaggctgtgactggaaaggcacctgggacagggaaggcggcggcgtgcttatcgatcaggccattcacagcatcgacaggatccgctatatgctgggaagcgaggttgaatggattgatggcagcatacacaatcattaccatgaccggatccgggtggaagataccgccgaggccgccatccattttaaaaacggctgtctctacagcctttatgccacaaattcctatgcgtccgatgcccctgtttttatggaattccagggcgaaaaaggccgctgcggtctgaagcaggatatcggcttctatgagcttgacggcagctatacggaaataaggccggcaccgtcagcggaaagcaccgccattcccgattattggggcatgggtcattatgcacaaatacacgacttttacctttctgtatgtaacgacatgccggtttccgtggatgtgacggaaggacgcagaaccctggaaatcgtaaagggaatttattattcctcccagcgccgtgaacggatttatcttccctttgaggataccaattattccgatctgaacacgccatccgtttctgccccgcctgccttctccatctgacataaaaatggccgcagtatccagtctttggacatcctgcggccgcctgttttttcttttattgttccatctgccttcctaaaaagcccgctgccgacaaaataagcttctgctcgacttctcccatctttccctttgggtcgttattcagaagaataactgcaccgatcacatccccttcacagataatggggctgatagcttcattcgtgtattccggttccccttcatccgctacctggataaaattcctttcactctttcccgcaagaatattatccctgttttcaatcgcctcctccagagccttgctgatcgattttcccaaaagtgctttacagccgcctgccgccgcaataaactgatccctgtccgcaatcagggtcatctgtccggatacctgtgcgaggctttccgcatactgcttcgcaaatgtactcatctctccgataggggaatattttttcaggatgatctccccttctctgtcggtgaaaatttcaagaggatcgctctcccggatacgcagcgtcctcctgatctccttggggataacaattctccccagatcatctattcttctcacaattcctgttgccttcatgcttcctccttctaaaaggttatcctgtctgtgccggacagcctcttctttacatttttaacatttatttcttttttgggttggtaaatgtagtatttgtaaaattgaggaaaatatgcaatgaatctttgctgaaactgcgttggacaaatatgtagtcatcttttataattaatttcataatataagctttacaaaggggatattgaggggattatgtatacatattttattgcggatgatgaaaccaaaatcaggcaggggctgcgccagctgattgactgggaggaactgggtttttattgtgtgggagaagcctccaacggagaggaagccctttctgcaattctggaaaaaaagccggatgtcgcccttctggatatccgcatgccccgcatgagcggcctggaggtggcccgtcttgcccgggagcataattatgaaggctctatcctgattctcagcggctattccgattttaaatatgcccaggaagccatgcgctacgatgtgaaatattatattacaaagcccgtggatgaagatgagctgacagcacacctgaataaggtacgtgaagagctggaagaaaaaaagaaacgctcctccgccattgaatattacagtgaaaaggcccgcaacggcattctcagcgattttttgacaggccatcttcacatcactctggaagaaatgaaagagctcggccttctttccggctgttatcaggcggctatttacgaaaaatacagccacaacgccgcagctgtttcctatcgtttttccgatttgctccgtctcaccaatgaggataaccattcctatgaaaccttaaccatcgatcataatgaaatcatcctgctgaagggagattttgccatccgccgtttttctgaattcgtagagcgattcgaacgggaagtaaagccgcaaaagggttctcctctggacagtctttttattacctacggccctgttgtttaccggccggaggatattgccatgtcctatgaggaagctcttcatcttctgaaaatgcgtttttactgtgatccggatcagcacaccttcggttatcatcagctgcagcagcaggcaggcagtctttttactcccgattctgacactctggatgaatataaaaacaaactgactgactatatccagacactgaatcgaagcatgatcgccgaaactctggatcggcttcgtgaagaaatttatctgtcctctgtccctattgaagatgtgcgtctttttttcatcgacctctacctgcaggtgaaagaggccatatgttaccgttatcatacaatggacatcccttttccgcccaacagctgggtagttgacttcattcataccagatactatctgtatgaaatcattacctttatttccgaacaggctgaaatgatattgtcctccttgggcaccacttcccgggaaagtaccctggaaaatgtccttcattatatcaaagctaattatatgaataatctgaagctggaacgaatagccccgcttttcggatacaacagttcctatctcggaaagctttttactcagaaaatgggaatgaattttaccgcttatctggatttgatacggattgaagcctccaaagagctgctgaaggagggttctatgaaggtatatgaaatcgcagaaaaggtaggctacagcaatgtggactatttccataccaaattcaaaaaatcagaaggaataagccccgcagaataccgcagaaagctgcgttaataaaggagtgccttatatgtctttaaagcacgtttcccatagccggattcaaaaacgtatgcatcggatgctgataccggtcattctcatccccctgctctttatcggtattttcctgtctttttatgccataaattttctttaccgtcaggcagaaacgcaggtggtatcggataatctgcgggcaaaatccgttcttttggatgccaccctcaatttttataccatttctgaggaattgttttccgacagtaatttaacccagctgcttattacggattataaaacagagtcggaagccgtcagcgcctgcaacagctatgaacgtctggcaaggactcatgccaataattccgccatctcttccatactcatttataccgataatcctactattcccaactgccgttatatccagcaggcagaacctgaaatgctggagcaatggtttcctctggtttctgtcagcggcagtgtttcctggcagtcgagcaccttagggtatggggaatccacctatccgggaactaatgaccgtactccggaattgacttttctgcgttccatccccctttccccttcctcgcatcatgcgattctggtcataaagctaagcaacaattatctgaaaaaccgaatccagaacaatgacctgtttacggctctttctatcggagaacagcctgtgtttttttccagcagccgtttttatcagggacaggctcagccggtacccatagattttgcccaaaaaggctttcacagcgaaggctttcttccttttcagggcgaaaaacagatcggctgcgtaaccacccttcccgcttatcatacagaaggggaattttatcttaccactattgatttacatgccaaagactccatatataaaattggatttatatgtctgctggtcctggccgccgccatggccgtatctttgttcggccttctttattccacccggtacttcagcctgcgggttaccactctgcagaccgccatgggacatgccagccagggtaactatgatattatcgacacttttaagggggatgatgagctcactgatacctttttaaacctgaaaatcatgataggaaatatcaagcagcaggagcttcagatgtatgaagccagaataaaggaacagacacttgtcaatcagcagcagcaaatggaatataagctgctggccagccagatcaatcctcactttatttacaattccctggaaaccatccgtatgatgagtataggaagcggagacagagaaactgcctccgccattaaactgctgggaaaaaccatgcattacgtgttggaaaatacaggaaccgccagtactacgctggataaagagctggattacatttcttcttatctggctatccagaagctgcgttttgaggagcgttttaactatacgatccatgtgcctcctgagctttccctttcttcctataaaatattgccactgctccttcagcctatcgtagaaaatgcaatcctgcatggtctggaagaaaaggaatacggaggccgcttaactatcactctgcatacggaagaagaaaaccatctgcttatcgccattgaagataacggcaagggtatgaccggtgaagaactgcagaaccttaaggagcagatggactcttccgcagaacccgatacttccggcagcattggactttgtaatatcagccggcgaatccgcctgatatatggtccgccttactccatggatattgcaagcagtcctgacggcggcaccagcgtatacctgcttctgccgctgctccctgccgactgatctgctgcaggctgccaaaagaaaaagccgcctcatataagatgagacggccctgtccgtatttattttgccagaaatttttccagcgtttccaaatccctgttggcaatcagtgtttccgggaaatgaatttcttcaatcatccgcagtgtttccggatacctcccgacagcgtgtgcggaatgagcatccgaattaaccatgatacttgtcccttcctgcgcgcacagctgcgctgctttccggcagactgcagttatcggctcaccgaacctgaaagatgcttcattgatttccaatgccttcccgagccttcccgcctcccggataaccggaagcatttcaaaccggtagacggatcttcccacatgtcccagcacattaactttgctgttattgagcaccttcatatacatctgcgtattcgccgcagaatcctccctgtcggtttccatttttcccggtccccgatgaacgcttgcaatcaccagttccatatccttcagggcctcttccaaaacgctttttccttcatgcatcacattgtaattagccagatgcccctgcagatccagaatatccgcttccattccccgtaatatgcgcactccccgaatatgggacggaagcactttcagattaatgaaaggaaccgctttgtccccgaattcctccgcccttataggacagaaatgatccgttactgcaatacattccagttgctgttcggcagcatataccgcacattcctctatagtactgtaagcatgtccgcttaatatcgtatgtacatggcaatctgtttttatctgatacatagtctctgtcctttactgaagtaccttctgtctttcttctttctgatccgcaaccttctgcatatcgatttccaaaattctttcatatcccagtccataaaccgtttcctgcatctggcggatatattcgtcaaattctgcttcatccctggcaaatacggccttccatgaatattccacaactgtggaattaatttgtgtccggattgttgctatctcggaatcctccgccggttcggaataggaacagccgggcgctaccagcacctgtccgtgatccttataatattccacggcagtcttgactccataatgcttctgccagtcttcgattaactcattgctgttcaattctgtataagaatcccacagagtatagtcatacggatggtttgtttccggattaatttccgcgctggaaatagccttgattcccaactgggattttccatccttccagcttcctccgccatattcctcaggcatctgcgcgtctccgtccaccagacactctttgccgaattcggtaagtaccggcgcctcatccttcatttcccaggtaagcccttccggcccgctcagcgtaacgctgtgtcccgcactgtttcctatcccttccggggaatacagccagtcaataaaatctgccatcctctggggatcctgtgctttacttccgatcatggcactgtttgcagggtttcctttggcataacatccccaggaatagatctgtgtatccgcaaccgggattgccataaatccttttccctcttccacgtgctccgtcacattatatgcagcctgtcccagccacggccagggagaaaaaagaacggcgccgtctttgtacttactgtaaagagtatcataattctgggtagtggattccggatccatcagtcccatctgatttgccatgaaaaacagcttcagattacgtacatatacagaattttcatccaccaagctttgaggaggaagggaatcatcagccgaatagacggcatctcccatgaaacgatagccatacagactgggcagccatgctccctgtttcatcgcgttatcgtcccagtccttaaacaatgaaaaagcataggttttcttcccggaatcactttcaggacataactcctgcatctccttcaatacatccagcatatcctccaccgtattcagttcggggcatcccaattcttcatacaaatcccatctcagatatacaccggaattacaatccgttccttccatgggtgtggtaggggaaagtgttgttacctcagacggaatcatgtaaattccttcttcctccaccagctccttattgctgtactcaatggcatccctgtatctttccaggttttcttctcctttgatcaagtcggtcatatccataaccaggccggcagtaaccaaatcctgaagccttcctctgtccgcagaagtaaaaatcagatcgcccagattcccggcagcgctccttgtctggaacagggtatctccgccccctgccacattgggtgcaataatattcagctccatattaaatttgtcttttacaattttggcaaaccagccggattgtattccctggtaattcgcctgagaatcaaacacatcaaccgtcaggaattcctcatacttactgttttccccggatacgccctctgctgcctgctgtccctgggcctccggcaccgccgctgacttttccgccccgcaccccgtaaccatggacacccccatagccgcacataaaatcatgcttacaagtttcttcttcataagatcctccttctcttatcataatatgatttttttgttctatcaacctttaaccgaacctatcataatccccttcacaaaataacgctggaacatgggataaatgaacaaaatgggcattaccacaatgacagataccgtcattcggatggatgtgggcgtctgctgtgtagccagtgccgccatattcaggtttgtccctccgctgctgttttttaccatagtcgccagggaattggcctgatttatatactgataaagtatgtactgcagggaatacagcttctgatccgtgacataaataagcgtatcctgaaaagaattccattgcgccacagctgcaaaaatagctattgttgccagtattggtgtggatgtgggaaggataatctttaagaacaccttcataatgcctgccccgtcaatttccgccgcttcctgaagggatcggggtattgattccatataagtcttcaccagaatgatattaaagggctggacaatcacaggaattacataaacccagaaggaattggtcagatgcaggttctgcatggtaagaaacatcggaatcagccctgcattaaaatacatggtaaccaccatcagccggtaccacagcttccgcctccacatacgctcctgagtaaacataaatcccagaaaagcagaagcaagcactgtacatattgttccgattattgttcttcctacagaaactagcgccgcaagtccaagcccttttaactgcagcacctgcttataattctccagatgtagctggctgggcagaaaattaatgcttccattactgcttaaatcattggcgcttaccgaattaatgattaaataataaaaagggtaaaagcaaatcagcgtaaacaaaccaaataccgcatagtttaaaattccaaacacgatatcaccttttgttttcttaatccctctctctttcactaaagctttcatatacagcctcctaaattatggattctcccctgaccctttgtgacacaaaattgacaaacaccagaagagtaacgctcacaatgctcttcatcatactgattgctgtcgccagggaaatacttctccccgtaatacccagattatatacatacagatcaagaacctggatatgtgtcttgttaaatgcattctggaaaacaaaatattgatccataccgttattcaggaaattcgctatggaaagcatcagcagcacaaaaaaggtaggcataagcgccggcagcgtaatatgccgcatcagcttaaaacgtcccgctccatccaccctggccgcctcgtacagctcctgatctacacctgaaatagctgccagatacataattgcgctccatccaagattcttccaagtatgccacaaaagcatgaaaagccatgtgtgggaatcactgtccaggaacttgatcgcctctgaggtaattccgaggttctgcaaaagtgtattcaccatcccggtattggaaaataagctgaatgccaccgaatataccagaacccagctgatgaaattaggaagcgtagtcattgtctgtaccagacttttgaaccatttacacttaatctcactcaaaaaaatggcaaatcccaaaggaagtattgacgtaacaatactcagaaaactcatggcaaatgtatttttcataacctgccacagctgtgccatctgtgtctcattgctgaaaaacatccgaaaccatttgaatcccacaaaagggcactgactcagctttaatggagccttataatcataaaaggcataaatccatccatgcagaggaaaataagaaaataaaaaacatagaatcaaaaatggcagaatcattaaaaacatcttcttcccctgccgttcgcgggcattcaccggtctttttccacctctccctttcattttccgactccttcctttccgacggaaagcactcgcttccgctcttgtttctaaagggattctaccattttatttttctgcgatatacgccatattttttaaaagctttgcatgaaaatacctgtattttagggtaatgtagaatttttgtggtaaaactggcagaatttttccggtagtttccaaaaaaaagacaggccataaaaatgacctgcccggattgtgttgagattctatattcttttttacaggaatcctccaaaatgcaaaggctagttatcctggttattaataaatgcattgaattccctgaaagaaatccccgccggaacgctgtaaaatggtgttgtcgggctttccttccctccccgcagttcgatataatagcctgctatcttccgaattgcctcctcttccgtatcatattcatatattccctttttttcaaaattaggatgttcaatatgataaacttttccgtccctccagaacaggacaaagcagtgcatatgctcctcttcttccaaattgccataatcatccggctcgtatatcctgcagcagaacattttattctttatattaattttatccagcagataatgcatgacttctgcctgttcgatacaggtcccgattttatgctccagggtttcctgaacagacatggttcgatattgtttcctgaaatttttcatttctcccacatgcctgccgccttccgtatcaagccagccatactgcatgttctcatccatccacaggaatatatcctccggggtttttatattattgatttccattgatttttctcctgatattccgtcaattatccacggctttcaacctgtagattatatcagaagcaatcagaaaaataaagtcccgaactcagcattctctgtttgtcatgccttctccaccgcatgttcccgatcccagtcttcatttgccttttcaaccttcagccgggacagaataattgtcgtaatgattaccgtgataaacgggaagcccagatacataaacttcagcatattaatacaggatgcggactgaaccggagcattcgcaacatagccgccggcttccaggagcattccggccagcgctgtacccaggcctcctcctattttaattcccagagaggaacaggagaacatggttccgtcaatccgtttacctttggtacggtaggtataatcgctggtcgccgcaatcagggcgttcaggtcgccggtaaccggactgacacagagaccggaaataactgaaaaggtaagcatcatggggatacttcctatcaggccgccgataataaagccgattcgcataaagaatgcaatacagtaaccggtcagattgaccttatacatgctcccggcttttttaaccagcgcaggagtcagcgccagccccacaatcataggaaacatctgtgccgcggaaaaggttccgagaagggccggatttccaaacacataggtcatataataaataccgatacctgctatacctgtctgaatataggtaagtatgtacactgccacgatcatcagataatatttattctttaccagaagcttggcggattccagaagagtcagtttttcttcctcctctttctttactgcgccttcgtcctcctccaccacttcttttacggaaaatacggaaatcgtatttactatcagaccgatcagcgcataaataatcgccacattacgccagcccatagctccgccgcccaattttccaaccaggcctaccgtaacggaagctacgataagattggtagcgagcgaaaacataaaccgaatggagcctacctgcacacgttcattgttatttctggtaatcagcgaggtaagggaagcataggcaatattatttgctgtatagaataccgcattcagcagcgtataggcgatgaagaaatacgcatatttcgcggtgtctcccaagctcttgggaatggcaaaaatagctaccagcattaccgcattccccagataagaccagagcatccagggacgcgccttacccattttactcttcgttttgtcaatgagagagccgaaaaatacatcggtaataccgtccgcaaatttggaaagcatcatcagggtaccggcaataccggcattcagccccaccgtatccgtcagataaatcatgacaaagctggtaaggagtgcgtataccatgtttgccgcaagatctcctgaaccgtaaccgactttattgtaccactttaaatattttttctcctgcatttatttatcccccgttatcttgttttttaccttctcagctttgacagcaagcagctctttttatgcacttataagctgacagttcctttcaaaagatcttcctctgcggaagaggttccgatatacatttcatattccatatgctccagttggaaggaagcgctcttcgtatcataatatttcagtttttccacagggcaggaaatctcaatctgcttctcttctcccggagagagtgttacacgctgaaaacctctaagtaattttaccggccggtctatcgatgaattgccaaagcccacatacatctgcactacttgtgcaccttccctgtcaccggtgttttttaccctgcatactgcccttacgttttctccgtccgcagagaaagcaggcttatcaacggtaaatgtggtatagctcaggccaaagccatagggaagcatgggccggattcccttcttctcaagcctcgcatagccatgataatactcatagtactgattcgcagtatcccagttaacctgcggcagatccttttcttcataagggagtacaaaaggaagctttccgctgggattcacatcgcccataataatcctggcaatgacgcttccgccttcctggccgggatagaaggccatcaggacagaagatacacaatcggcccaatccgtcatcattatcatgttgccgccaatcataaccacagcggagttcttgttttccggtcctgctgccttaatcaattccacttcgtccgcatggaggcccaggtttttccgatctccgcctatggctccggtatagttttccgaattttccactgcgacgaactcgccttcatcatcatgatcaaagcctaccacgaaaatgacggcatccgcttcctttgcaacttcccttgcatgctccagatcctctccgctgtaccagatcacttccgtatccggaaggatttcattgaagccgtccatgggagtttttacataggcagggaatacccggcttgatccatgatccccgatattggccttattcgccagcttgcccagcagtgcgatctttttgatcttctctttttgaagaggaagtactttattttcattcttcagcagaacgattccttcttccgccgcacgttttgccagctccacatgctctttgcagcccagaaccgatttatcatacgcatggccgctctttcggtaggaatcctcaaaggcaaggattgtacgcacgatgcgcagtgcggaatcgttgatgcgcacttcgctcaccaggccgtctttgaccgcctgcaccagcttatccccgaaaaactgggtgcagcacatttccatgtcctggccgccgttccccgcttctgccgtatcctttactccccatatgaaatcgctcatgacaaagccgtcaaaatcccattcttccttcagcaccttacgaagcagataatcggaatggccgcagtggattcctttataaaggttataggagctcataatactcgccgccccggcatccacacaatccttgaaatgaggcagataaacctctctttcagtacgtctttcgcaatccacactcaccttaaaacggctgatttccatggagttaaacgcataatgcttcacacaggccatgacatcctcatcctgtacgcctcttaccagcgccgctcccatacggcccagcgcgaagctgtcttccccgtagacctcctggctgcgtccccagccggggttataaggcagattaatacatacgccggcaaacaggttcccgccgtgccctctgacctcacgacctatggcgtgcccgatttcctcctccagttctacatcaaagctggcgccgcggcacatcgttacgggaaaacaggtgctttcccctgttccgcacacaacccctctgggcccgtcgcagaaaagcatgggtgcaaccccttccttttcatttcctcctgccggataaggctttgcattatagtgagacgcttctcccatcgcatcagccatcatatcctgtaaggacagattcccgctcatcagataaaccttttcttccagagtcatccgatccacgatctgctgcgccttctccgtaaattggagtctcttttccttcgcctggttcatattgctctcctttcagttttctgcataataatgcagtaatttttccgcttcttttttatcaaaatttaaatatccctgaatctctttttctaccggccctgtgccttctccccttctgtattccttgggagttatgccagtctccttcttaaaaacccggtaaaaggttgcttcatttgtaaaaccgcactctcccccgatcacagaaatggacttccggctcatacgaagaaatcccttggccttttccaccctggccgtatcaatcatttccttcggtgatatcccgagaaagcttttcgtataacggtacagcgatttttcgctgattccgaaatgtctggaaacggactcggtcagattctgctgtccgcagttggcatcaatataagcgcctatttccgctaccagctgtccctccgccgtgctgtccgtatgtcttggataacggcggatatcatactgcacgccctccgccagtccggccatcaattcataaaaagcggcattttgcgccagataagccgcggcatccttcctgtataccgtaaggcctgttttacaggccgaccgcctcagtatttcgtaacctcctttcggtgggaattgtttactcacgctgttcagataaaagaaaagctgttgacccttccccgatatatgttcaaaaatatttgagggaaactgaatgaaaaggcaaagattttcctgatctccccggtacccgtgcaccattttgctgttgacaagaaagatatccccttcttccatcagcatgggactgggcccgcagagcacctgaagttttcctttcagcaatacaagtatctcataatcataatgccaatgataatgggagctttccattccggtgacaaatatctttgcaggggccaggagctcatgttcaattggttcaaatacgctgttgttcatattccctcctttcgtcttaccgtcatcttatacaagaagtatagcatgtggttttttcatttgttgtcattttagataaacaacactattaaaaacggacttttatatgcatttacgttgtacattttatggctgttactccaaatcccaataatgcttacagcattttgtattatacagccttttttgccgctctggctctttacggaaaaacatgccggatgaccgtatccgttcttctgtctccggcaaaaaaacgggcgctggtgtttcatacccaccagcgcccggaaaagacagcttctatatgctccgttattttgtcacattaaaaataaagaaaatattacagtcagtatcccgcatactccgatagcgagcccgctcatagccccttccgtctcccccagttcaagagcctttgacgtccctatcgcatggctgcaggcgccgatggcaagtcctgccgtcatggaatccgaaacacggaaaatacggataagccagggagccatgatgcttcccataattcccgtaataataacggcaaccacagttaccggcaccatccctccatggcttccggagatccccaccgcgataggcgttgttaccgatttcggtatcaaagaattggtcatcgcctcgtccaggccgaaaagccggcagagcagataaacgctccccatggaagtgagcgcccccaccgtacagcccaccaaaataggcagccagttcttttttaacagctccgctcttgtataaatggaaaccgccaggcagcttgtggccggagccaggaacatgttgataatactcccgccttcattataagcttcatatggtatccggaacaaaagcagaaccccgataaccagtacaatcgcaataatcagaggattgcataccacaagccccgttttcttctggagccataccccgatggaaaaagccaggatactcaatgcaacaccgaaaaagggagaagacatcagttcagccatttcactctccccctttcttcttacgcatcagctttaatgtcagttttatacttcctgccgtagccccaaaagtaaggattgtagttatcaggcagatgaacagaagcttccagacggcactccggagcacatcaaaataattgataatgctcactcccgcaggaacgaagaaaaaagccatattcgccagaaggaaatccgatttttcccggatatgctccaccttaagaaccttacaggaaagaagcacaaacaggagcaccatcccgattacgctggcagggaaatcaaagggaagcagtttctccacaatctggctcacccagcatatggaaaaaataataccaatctgatataagattttcatcgtttgtctacccttccaccataatctgacacattttcatggtggcaagcgccgcttcatgactttccggagtcactcccgcgcagcaggaggcatccacaccgattcggttttccggaaggaagcttttgagcagaagggcattggataccacacagatatccgtacagaggcccaccagttcgatttccagctcttccttttcgttttccctgtaaagcagcttcgctaaatccgtggaaccaaaggtaggtttatccagaataactgcctgcggcatggcttctgcaacctcaggccggatttcccaccccttgcttccttttacgcaatggactaccggcaggttcttcccctcgctgctctccagataatcctctccatgggtatccctggtggcataaatacagtccgccggatacgatttgattttactgatcactttgcttacaattccctgcgcctgcacagttcccaaagatccgtcaataaaatcgttctgcatatcaactactacaagcacctttttcatttcactgtccgcctttccattctcttttgtacaaccgttttcagttaacatatcaaaggtaacattgttacacttcacggctccggtgccgccggtcttatgcttctgcccgtccggcattccctgccctgtcttgtggggcgcggttctgcaaggattcctgtatgggccgtataaatacgccggtccttaggctgcgtactctgcagccttagtaccgctgcgtatttatccgaacaaaagtgtgccctgacaggaaccttgcagaaccgcgctccacaagacagggcagggaatgccggacgggcagaagcataagaccggcggcaccggggccgtgaagtgtaacaaaaccatcagtttaaaaggatttccttcatatcttcaagcagcccttctgcaagccgtatcagattctccgcatccttctcaaccacaccgcattttttgtaacggtataaaaataccggcgttcctctcgcgctgaaggtgagcttattcttatgctttccaaggatttcaggaatgttttccacacggatgcccgcatccggacgcatggtgagcttcaactccccgtttcttcccttcacctctgttatatacagctcatgggccagaaccctgagcagggcgatgcgcagcaggttatccacagatttgggcacctctccgaaccggtcaagcagttcttccttcatatcctcgctctcggcatgggtttccacaccggcgatcctcttgtaaatatccagcttctgctgctcgttcacaatataggaaggcgggataaaggcatccgcctccagctccacagttgtggtgaagtccacaatgctcttttcccccttaaggttcttcaccgcttcattgagcatcttacagtaaagatcatacccaacggcctccatatggccatgctgcttgcggcccaggagatttccggccccccggatttccagatcccgcatggcgattttaaatccgctgcccagatccgtgaattcccggatggctgaaagccgtttttccgcaatctccttaagcatcttatcccttttatacatcaggaacgcataagatgtccggttggaacgccccacacgccccctcagctgatacagctgagacagccccagctgatccgcatcatggatgatcatggtattcacattggaaatatccagcccagtctcaattatcgttgtcgccaccagcacatcgatctcaccgttgataaaatcatacatgatccgttccagctcatgctccttcatctgcccgtgggcaaaagccacgacagcctccggtaccagctgctgcacggccgccgccacatctgcgattgtgttgacacggttatatacataatacacctggccgtcccgggtaagctccctgacaatcgcctcccgcaccatttcctcattgtattcgcagacaaaggtctggatgggaagcctgtcgctgggcggctcctccagcacgctcatatcccggatccccaccagcgacatgtgcagtgtcctggggatcggtgtggccgtaagcgtaagcacatccacattatcttttattttctttattttttccttatgagtcacgccgaaacgctgttcctcatcaatgatcaaaagtcccagatccttaaactgaatatccgcagaaaggatcctgtgggtcccgatgacaatatccacctgccccttgcgcagatcctccaccgttttcttctgctccgaaggcgtgcggaagcgggacatcagatcaatccgtaccggaaagtccttcattctctgggcaaaggtattatagtgctgctgggccaggatggtggtaggcaccagaaacgccacctgcttcccatcctggatagccttaaacgccgcccgtatagctatttctgtctttccatagcccacatccccgcaaataaggcgatccatgatgcggtagctttccatatcctccttcgtagccgcaatggcggaaagctgatcatccgtttcctcaaagggaaagcattcctcaaactccttctgccacaccgtatccttggaaaaaggatagccttcctgctgctgtcttatggcataaagctccaccaaatccttcgccacctcatctacggcgctgcgcaccctggatttggtacggttccattcctggcttcccagcttattcagcttgggggctttcgccgcatcggaggaagcatacttctggatcacatccagcccggtggcaagcacatacagattgccgccgtcgcggtaggaaatcttgatgtaatcctttacaaccttatccacctccaccttttcaattccctggtaaacacccagcccatggctttcatggaccacataatcacctatccgaagctcggcgaagtcattgattttctggccttcaaattttttcttatgctttttctttttcttctggaccccgaaaatatcactttccgtgatcaccacaaatttcagcagagggtattcgaaccctcttttcacatgcccgtaataaagcatcacctcgccggaatttaccacccgttccccgtcttcgctgtaaaagctggccagcccctgctcctgcaggtcttccgcaagacgcctggccctggtgcgggagccggaaagcagcagcacccggtatccgtttttcttataccttttcagatcggaaaccaatgcgtcaaagctgctgttataagaggacatgctttttacattgacatcaaattttctctgtggcttcagcagcgcatttgagctgtccatagaggaaaacagcaccgtccgcatatgctgaagaaagcctgccgtttcctcccagccataaagcagatccgcctgtccggggaggatataccccttctccagccggtgccccatgctttcccggaactccatttccaccgccagggcctgctcttttacccgcgccgcctcatcaatgaaaacacagctttccccctctgggaaaaaacggagaaaagaaacggtatcctcataaaaataccggatatagctttccagattggtcatctgggaaaattccaaaacctgttctctcagttcctttatctgggtttttgcccggtgtgcttcttccgtcagaaaagaggaccgcagtttttcttcgaattcctttgcttccttttcaatccggcgcagtcccttttccttctgttcttcagacagcatcatctccgtagccggataaatatccacctcactcagcttttccacactgcgctggctgagaagatcaaagctccggatggattccacttcctctccccacagctcaatacggtaaggattttcttccgtgagatcaaagatatcaataattccgccccggatggaaaactgtcccggcgcatctacctggtagtttttctcatatcccatttcagcaagcttccgggccagctccccctcattcaggctgctgtccgcatcaatatgaatcacagaggcggcaatctcctccagagggacctgaggagacatcagcgcagcaaaggttgtgattaccgtcagcggctttccctctataatttttcggagcgccttcatacgttccgtcacaagctggttgccatggatatccgcctgatagaaaataagatccttcgccggataccaggtcacctccctgtcataaaactgataatcctcaaagatctccctggccttcagatcactgaaagtaacgatgattttatatcgaaaaccatcgctgagtccataggccatatgaagcttctgggaatccacgcagccagtaaatccgacacaggctcccggttttttcaggagtgcctgcccttcttcaaattccgccagttcccgtaacggtgctgtgattgcattcatctacttttccccgcctgcccgctttccgttaaatctgttcatggcctcatccggccccttctccatcatggtaacggcagcctccaccgccagagcaatgcactcgtccataattttacgttcccctccggtgaaatgccccagcacatagtccgccagatcatacccttccggtttgtttcccactcccatcttaatccgggcaaagccgtccgtccccaaatgggcaataatattctttaaaccgttatgtccgcctgcacttccctttttacggatacgcagctgccccaaatccaggctgatatcatcacaaaccacgatcagctctgtctgaggatctaccttataataatctatgatctcacggatgctttcaccactaagattcataaaagtctgaggttttgccagaaccaccttcatcccgtcgatatatccccggcccacaagagccttgtgctttctctcaatcacgcgtatcccatatttgtccgccagcgcatctattacatcaaacccaacattatgccgggtattctcatactcccgtttcggattgccaagacctgctattatatacatgatttccatttccttcccatagtaccggccgctccgggaaacccttcccgctccccgtttaagccttatgcttagtttaatgccagatcgttaccctgtcaaatgccgcagccctattccgtctcccttatttccttattttttacaaataccagctgtttttcagaagaatactcctcccggtatgtatatcccagcccgcagaagtccttcagactcctccagtccctgatattattccctgccgcaaaccgcaccatctcacctctggccatcttagcctgcgtccccttctgcactaccggaatcccctttttcttcccatccttttcagccgtcccctcttctttttcttccccaaaaacacaggtaatatactccacaccctcctcaagccaatcctccacacaccgtgaatactccttcgaagccagattcacaatacaatccgtttccgaaaccagctccttataaatcgcatccccccagaaatcataaagattcccctctccgccgggattccccttagcctgcatctccagccgataaggcaccaccccgtcaagcggcttcaaaatcccataaaaccccgacaatatccgcagatgctcctgcacatacgcccatgccccatcctcaaaaacccccggagccatatactgatactgaatcccctcataagccaaaagcgcaggagtcagccccttctccagatccatcgaccgaatcctttcataatttaatgccgcaattttatcattacacctccaaagcaccttcagctccccttcatccatccccctcatccactccaaaagcacctccgtcttccccaacaaaaccggtttcccgccaacctccatcgtatccctgtccacaatcatcttcttcgccggtgaaataataaacctcatatctctcattcggttccgccgtcgtccctcccgggatattgccttgcccgccctgcctttccggtccgaatgcctccggggattacagccctccaactgcccggggcggtcggtggatcctgtaaggggcgtcataaactcgccggtccttacgctgcgtattttgcagcgttagtaccgctgcgtgtttatccgagcgaaagcgtcccctataaggaccaccgaccgttccaggcggttggcggacaggaatcccctgaagcagccggaccgaaaacgaagcggcagccgataccacgggcggggaagggagggacgacggcggaactgctcctccttttgttgtttaaaatgtgttatactaacttttatcattttttttggatttgcgcaaacttttttccttcctgggaagtctaattagtgtaaagggatgaaaatacaagattcatgaaagaaggtggggcacatgagccaacatttaactaagaaacaattcgcacagtacatggaaaacggaaaggcaaaattttatcgtctcgctttctgttacgtcaaaaacgagcacgatgctcttgaaataatttcggaagccacctacagaggatttattcatctgaacaagctggaaaaaccggaattcttcgatacctggatgagccggatcatcataaattgtgcttacgatttattgaaaaagcagaaaaaatatgaatttgtcgttcccgacgatagcctttccgaacctccggatgcagtttccattgacgagcgcatcgatttatatcaggcgctgaacaccctgcacccggaagaaaaaacattgattatcctcaaatattttgaagacagaagcttccgtgaaatcgcggaaaccatgaaactgccggaaagcactgtgaaaacccggctttaccgtaccatcggcaaattaaaagaagccgtttcggtctgacaacactcaagaaaggagctgctgttatgaataaaggaaaagaaaactacaacaacattcccctgcccgacggcctttccgacgccatccggaccggattggacagaggtcaaaaatatacggcaaaaaaatggattaccggtttcggctctctggccgccgcctgcctgtgtctggtcgtaattatgcggatatttccatttacaaacgggaccggcggagataactccaatatcccttcccctgccaattcttctgacacgccggtaacgccccaggccttctccgatgaaagacccgtagaggttcaggaaccggagaattaccggataccctgcaaacagacatcggaaacctctcccaaaatgccggtttatcatgtggaagaaaaatgggctccccaccgcctcatttttaccctttatgacatccgtgatttcgacttcgatgctgtgagcaagcctctcttggagtcttccatggtacaggatgtataccgcagcatcctcctcgatgattctgccgtaagctttgtggttgaacttcccatcaatatcgaataccagctttcggagcataccggggacggctatgtggaactcagcctccgcccttccgataccgcggatgaaatacgcgaaatttattttctctcctcccctgaaatggacggcggagaagaaaccgcactgttccgggaatcccttcctgccggagaatacagcatagtgaaaacccgggaaggaaaattccttgtagttacaggcgaatttgaaacacagcaggaggcggaagaaatgcttgcacaattggaacagaacggaatggaacccggaaccctgcaggtcgcatcctgtatgagcgatgaatcccctgcgggcagcgcctctcaggataccgtcaccctgccggagacaacaatgccatcctctatccgtgtatatggtacggtgacggaaatcaacggcagccaggtcacaatttccaacgataaccaggaggacccatattccacaatcatcctcaacattaatgaggacaccctcatattaaccgcagaagactgcaaagaaaaaactcttaaggatctgcagaaaggcgacaccctttacgcctatgtcagcccggtcatgaccaggagcctgcctcccatgtccaacgccgaattaatcctctgccagattcccgcagacatgatggttcccacctatgctgctattaccgatgtttcctccgatccggacggctctctcagaattatcacggatcaggaactggtttgctacatcaatgaggataccattattaagactctggacggcaaaaaggatttggacagttccgcacttcagtccggtaataaaatactgatctggtaccagattgccacattaagcatacctgcccagaccaacccggatgagatccgtgtacttccctgacttaatgcccgctgatacaaaataagcagcgaatggtcttaacagcacaacaggtttatttataaaaaggtttcttaccggcctgacaccaagcccggtaaggaacctttttacttcctcaaagcctccaatttattctttcgcttccgccgctgccttctgtacaaaggcttccagatcctggcttcccagatccccctcatccctgctccgaacagaaaccgtaccgctctcctcttccttctgtcctacgataagcatatagggcaccttttccatctgtgcactgcggatcttataaccgattttttcatcccggttatccatttcacatctgagtcctgctgccttcagcgctgccataaccttaccggagtattcaaaaaacttctcagaaataggcagcaccttcacctgcaccggagccagccataccgggaatttccccgcataatgctcaatcagaatacctataaagcgttcgatggagccaaacacaacgcggtgaatcatgataggacggtgcttttctccgtccgcccccatatattccgcctcaaaccgcataggcagctggaaatccagctgaatcgtaccgcactgccatgttctgccgatagaatcctccagatggaagtcgattttaggtccgtaaaaagcgccgtcaccttcgtttaccacataatccatccctgtttcctccagagcgcggcgcaggccttccgttgccagctcccaatcctcatcgctgccgatactgttttccggacgagtggaaagctctacatgataagggaatccgaacttgccgtatacttcattgatcagcctcataacccccttgatttcatctgttatctgttcctccgtcataaaaatatgggcatcatcctgagtgaagcagcgcacacgcatcagtccgtgcagctggccggatttttcgttgcgatgtacaatccccagctctcccatgcgcagaggaagctcccggtaggatctgggctgggatttatataccagcattccgcccgggcagttcatgggctttattgcataatcttcatcatcaattgtcatggtatacatgatatcccgataatgatcccaatgcccggatgtttcccaaagctttctgtttaacacgatcggtgtggatatctcctgatagccttctctttcatgcagttttctccaataatccaccagtgtatttttcagaatcaggcccttgggaagaaagaacggaaatcccggtccctcctccataagcgtaaacagccccagttcctttcccagttttctgtgatccctctttttagcctcctccatcctctcaagataagctgccaactgctctttatccgggaaggaagttccataaatcctggtgagcatcttatttttttcattgcctctccagtaggctcctgccaggcttgtaagcttaattgcctttacatatcccgtattggcaagatgagggccggcgcacaaatccacaaaatccccctgcctgtaaaaactgattaccgcatcctcaggcagatcctctatcagtgtgaccttataatcctcctttttctctttcatcagggcaagcgcttcttccctgggaagagtaaaccgctccagcttgaggcgttcctttacaatcttcttcatttccttttcaatcgcagcaaagtcatcgctggaaatagggctgctgaaatcaaaatcataataaaacccatcatcaatggcaggcccgatagccagtttggcatcaggatacagacgtttcaccgcctgcgccagtatatgggaggttgtatgccggaacacagcggccccttccttttcctcaaaattcagttctccctgcattccattcttcataattacttccattactttgttctcctttctcctgcaatgtttttaggtttacatccatcccgggcgccggcaaaagcacattaaaaagcaccctcagaaaaaacagcattacctgttcttctaagggtgcattccatttgtataataaaaactatgagcatctgaagcctttcggctcttcttccctgatttttatggatcggttatgcacggttccaccttaatttttcacttcagattctttcaaatcctaatctttaacgcagatatacggccacatttatctctgctgcacagccttcacatggcggctccggaatggtcttcacctctctcatccgtaaaagggcttccagcttctgcccttctctctggttacgctgacttaaggctactctttccttcattgcttttcgttatttaactgtatattagcattgcataaatggaaagtcaaccatttttaatttttgattttttaaaatcatcttttcaggcagccttccggctttctatatctttctcttctctttccagccactctccatagtactcccggatcacagtaaaaggagccggtccgatatccagaagaaatgtatggaattccatagcatcgaacgcactccccagcgcttcctccgcttccgccctcatcctctcaatctccagatatccggtataatacaacagataattggagggatccgctattatactgtcataaatctcatctgtcgtttcgtcgctgacagaaaaaaactggcggataaaatcagcggcctctttcctgtcccagccctcgtaattaatccggatatccagcagtgcatacatccctttggtaatagaactgttccgggccagaatttcacccattcccttctccagaccattcccttcaaactgataagagcgattttccacataggttgcccacccttcagaatatgcggaaaaattaagcacatgacgaagttcctgtgtctccttcctccgaaaatattcgtgctgatacaaatgccccggaaacccttcatgagccaataaggtataggtatcatagctgctttttccgccgttaatataaatcacattttcctgcggccgatccatgggaggcaccatataaaacgcaggactcatactgtcctccaggctttcaggcacatacttaatccgatactcactatccggcagctgcggatagtcctccgcaattgcctcctgtaaattttccagaacctcttgaggatcctgactgaaaaaagaatactcaccgaatttatccgcaagctccggcgaccggcgcaaagcaatacctatggcatttatatccgcctccagctgctcttccaccgccttccttaattcatctaccgtggaaaaagaaggataaatactgtttcccaccaaatattcatagtatttacgtcccttcgggaaataatagattcccaaatcattgcttccgcttcctttcagcgcttccaggccctccgccagtttctcgtaagccggaacaaaatgctccttcagaagctctctgttcttctcgatataggcagctttttcttctccgtttatttccggaagctcctccagccgctcctgaaaggcttcatccaacaaagagccctccacatcctctatataaacccgacaggattcaatcaccttatccgccattcgatcactcataaaaagaccctcttcggccttctttttttcgaattccaaaagctcattataataaacatcaatctcttccagaagcccaagatatgtatccacattctgctttccataaaaacggtattctgcaagaagtaccggaagcatcagatgcatccccgtaaccgtattcagaggctcttcatacagctccagcccctttccagccccttctcccttcagcatctccgtcagagtacgatatgtaatcctctgctcttctgtcagctcatcctcttttatacccttcagcgcactcagaatctctttgtccagttccctgtcattctccatttcctctacggaataagaagaaaaagcggaatctgctttcgtaatcccatagacctgcggatccgccagcgtatagttcaatgaaagctcatcctgtgacgccaattccacaaacaaatctcttgcaaaactgtcaaatacctgaaccggatcctgcttcccattttcagcaaaatcccccgccatcgcacttccgcatcccggcgccaggctcataaccaataaaactacggagagtataatcgctgtactgtttttccctgtcttatttctcttctgtctgcttgtcagcatatactttctgtcctccctgaaatcaaatccttagattcccttgatgtcctgtttacgttacgtttcgcagttactcatcccatttcttttgtgccggccgtcttctccgtaccgtgtgcccggcctgtcgcttccggtctttggtacctgccgcggctctgtaaggattcctgtaaggaccgttataagctcgccggtccttaggctgcgtcctctgcagccttagtaccgctgcgtgattatccgagcgcaagcgtgtcctgcaaggaaccttacagagccgcggcaggtaccaaagaccggaagcgacaggccgggtacacggtacggagaagacggccggcacaaaagaaatgggatgagtaacgtctcacaaaaagcgggaatgcatgtgcattcccgccttataatcaaattccttcgtccggctccagcagtgccttctcatacctgtccagaataatattctggatattctctcttgttgcctgattaatcggatgggcaatgtccctgtattcgccgtctgtagcctttttgctgggcattgctataaacaatcctttctctccttcaattactttgatatcgtgaacgacgaattcatcatcaattgtaatagatacgatggccttcatctttccttccttggtgattttgcgcacacgcacgtctgtaatcttcatttgagattcccccttttatctttagatgacatacctctcgtttttttctaccacaatcttaatcccgtcttcccctttatagaaagtattggcccggatagtatccctgctttccacaatgcagttctcaatatgggtattatcaccgatgtaaacgtcattcaagataacggaattcttaatatagcaattgttccctacaaaggattttttaaatattacggagtcttccaccgtaccattaacgatacatccgctggaaatcaggctgttgctgacttttgctcccacattgtatttggcaggcggcaggtcgtcaaccttggaataaatatcaggatactgcttaaagaaataatttctgatttccggcttcaggaaatccatattcgtggaaaaataatcttctaccgatgcgatattgcgccagtattctttaattttatatccgtatattcttttctgattcttatagcggatcaggatatccttaacaaaatcatatctgtcttccatagcgcagcgctcaatcatttctatgagcaggcggcgcctgataacataaattccgcaggaaatggtattggacttggctacaataggcttttcctcaaattcctctatccggcagtcctcgttcatcttaagggtaccgtagcgttccacattagcgccgataggcatgtccttgcacaccaccgtaatatcggcctttttctcaatatggtattccaggaccttattataatccattttataaacacagtcgccggatgcaattaccacataaggctcatggctgctcttcaggaaagacaggttctgataaatagcgtctgcggttcctctgtaccaatagctgttgtccgccgtaaccgtaggggtgaaaacgaacagaccgccctgtttacgtccgaaatcccaccatttggaagagttcagatgctcattcaggcttctcgcattgtactgagtgaatacgcccaccttctggatatgggagttggacatattgctgagcgaaaaatcaatactcctgtagcttcccgcgataggcatcgctccgatagctcttttctgagatagctccttcattctgtgattattgccgcctgctaaaattattcctatcgctctcaattttcgtcacctgccttaattaaagatttgccgcttgcaagagtgcctgcctggtaatccgtatcatccgtctctccgaatatcaccgtattctttccgatctgtacgtttgtggggatagtactcttctctccgacagttacaatgccgctgttataaatatgaggtgcgatatcgttgtcggcctcatctcccactcccattttgacgttatcgccaaccagcacattctctgcaataatggccttattcagctcacaatgactgccaatgaccgtattattcataataatggaatcgcggatcaccgtatcttttcctacagtaacaccgcatccgattacggaattataaacctttccgcagatttccgatccttcaccgattatgcttctctcaatcacgccgtccggagctatatactggggaggaaggatctcactcttggtatatattttccaatattcttcataaagattgaattcaggcacaatatctatcagttccatattggcttcccaataggaattaagcgttccaacgtctttccagtatccgttgaactcataagcatacatgggggccccgttttcgtggcaataaggaatgacatgttttccaaaatccagattgggctgatcggctctggctatcagcgcctccttaagggttttccaattaaatatgtaaattcccatagaggccagattgcttctgggactctccggtttctcttcaaagtcaacaatcttactgttctcgtccgtgatgacaataccaaaacgcttcgcttcctccaccggcacgggcattaccgctatcgtgcactcagcgccgttctgcttatggaagtcaagcattacctcatagtccattttgtaaatatgatcccctgacaaaatcagaacataatccggattgtaactgtccatataatcaatattctgatatatggcattagccgtacctgtataccattcgctgttctcactcttttcataaggaggaagtacagtgacaccgcctatattcctgtccaaatcccacggaataccgattcctatatgggtattcagcctcagcggctgatactgtgtcagcacacctacggtatccacgcctgaattaatacagttgctcaatgggaaatcaataatccggtacttgccgccgaaggacacggcaggtttggccactttggaggtcagcacacccagcctgcttccctgaccgccagcaagcagcatagcaatcatttctttcttaatcatgtcatcacctcatgtttctgcatccatattctgcatagatttacgtatataacgtaataagattataacacatgcttgtacaaaagtgaataatcttttacaatttctttctgcgcttattttttaaattttgtgtatatttaacatatttaaaacattaacttttcttctattatctattttacataacatatgcccggtatttcttatgcacctttcttctatttttcacaaaatatgcggtatttcgacaaaaattccttttactccgttttgattttgtaattccctattggtttttttttcatgaatgcgtataatacatatcagaatgaacaaagactgcttactctgcgtacactgtcagtagagggcgtaaatggctgatggcagatcgttttgtccaaataataaacaggaagggtatccctatgtatcaagtagattttaatcatccggttcacatttacttcatcggcatcggcggcatcagcatgagcggcctggcagaaattcttctttccgaaggcttccgtgtatccggttccgacgcaaaaaaatcatctcttaccgaacttctggaaaaacagggtgctgttgtccactacggacagcgccgtgaaaatataacaaatgatatcgatttaattgtttataccgccgctatccacaaggataatccggaatttgccgccatggaggagctgggtcttcccagcctgacccgcgcccagcttctggggcagatgatgcgcaattacaaaacccccatcggcgtgagcggcacccacggcaaaaccaccactacctccatgataacggaaatactgctggcggccggtactgatcccacgatttccgtgggaggcatcctgaaatccattcagggtaatatcagggtaggcaagtccgatctttttgtaacggaggcctgtgaatataccaacagctttttaagcttttatcccagaatcggtattattcttaatatagaagaagaccatctggactttttcagggatttggatgatatccgttcctccttccgccgttttgcacagcttctgcctgaagacggcctgctcattataagcggcgatatctccgattatgaagaaatcaccagagggctttcctgttccgtcctcacctttggctccgattcctcctgcgattattattatgacggtatcagccacgatgaatttgcccatgcttccttcaccctgcaccgccgcggcggatcagatattcctgtcagtctgggcgtccccggggaacataatatcctcaacgcactggctgcgctggctctggcggattatctgaaattagatatggaaacagccgcacgggccctgaaaaattttaccggcacggatcggcgtttcgaatacaaaggatccgtagagggaattaccatagtagatgattatgcacatcaccctacagaaattactgcaaccttaaaagccgccagaaattatccccaccagaccctctggtgcgttttccagccgcacacctatacaagaaccaaagcctttcttcccgaatttgcccaggccctttcccttgccgacaaagtgatactggcagatatttatcctgccagggaaacggatactctggggatcagttccaggtccttgcaggaaataatcgtaaattcaggaacggaatgtcattattttccttcctttgaggaaattcagaaatttattttagaaaattgtacccccggtgacctgttgataactatgggggccggagacgttgtaaatataggagaaaacctcttaaagcaatagttatccacaatatccacatttttcatgtgtatgaaaagtgtggatatttgttttttgcctttccccggtttccgtgcccccacacttataatccacattatccacattttccacaattcctgaaaatccagtgtttacaaggtttttcggcattttgactgtttctttttccacacccttatgatataatgcatttgcttaaaatagaaaatagaagaaataggtgagattatgagttgtctgaggatttaccaggataactatattgacgcgaccatcgtctccaaccgctttatcgatgaatatatggcggaagccaacgatgcgcagctgaaaatatatctgtatcttttgcgcatgatgaatgcaggacgtaccttcagtatttccggaattgcagatgccttcaaccacacggaaaaggatgtgatgagggcattaaaatactgggaaaaatgcaaggtactttctcttgaatatgataatgagaaaaacctggtcggtattcatctcctggagcttgaaaataaggaggaaccggctgtttccaaagcgcccgtagtttctctgctgccccggcaggaggagaaaaacgaggaggcggaaattctcccggaaaaggccgaagcaaaaagtgcagtctcttatgctgtgcagtctccttccaaggaagaaaataagccccctcaggctgccccgtcggcgtttgccaagccttcctataccctggacgagctgaaggccttccaggaaaaggaatccacggcccagcttctttttattgccgaacagtacctgggcaggactctgagcccttccgatatgaaatcgattcttttcttctctgatcatcttcatttttcagatgatttgattgattatctgctccaatactgcgtggaacgcggaaaaaaagacttccgttatatggaaaaggttgccatcagctgggcggaagccaatatatccactcccgcagaggcggaaggacatgccagccgctatgataaatgtgtttattccattatgaacgccctgggcaaaaccaattcccccaccaggaaagaagcggaattcatccgccgctggcgtgaggaatatgcttttgaaacagatattattatcgaatcctgtgaaagaaccgttttggccaccgacaggcaccgtttcgaatacgcggacaagatcctggcctcctggaaggaagccggagtacatcacaaagccgatatcgccaagctggacgaaggtttccagaaaaaccggccggcaaagcccgcatcggatcgttccattgataaatataatcgttttatgcataacgattacgattatgacgccctggagcaggagcttctgcgtaactgaatcagtctggtaaaggagaacagccgtggccttaacaaatacccaatataattccatcatgaggctgtacgagcagagacagaccaaaaaccgtcatttacgtgacgaacggcttcattatgtatataatcatgtgaccggataccggaatctggatgaatccgttgccaccttatctgtcgcacagggaaaaaagatgctcaatggcgatcttaatgccctgtccgaactgaaagagcggctccataagctcaccagcgacaaaagaaagctgctgtgcgacgcaggacttccctctgattatctggagcctattttcgactgccccgactgccaggatacaggctatgtcaacggcataaaatgccattgcttccgtcaggcggaaatagaactgctctatcagcagtccaatctgaaagaagtgctggaaaaagaaaattttaatactctgtcctttgattattttcaaggggaagatctggccgcttttcagacagcggttaaacggtgccaggatttcgcccgtaccttcagccattcgggaagcaaccttttcctttacggtacggtgggaacaggaaaaaccttcctgagcaactgtatcgccagagaatctattgaaagcgggcattccgtaatatacttcagcgcttccagcctttttgacaccctttcccgcaatgcctttgattttaagaaccaggaaaccctggactacttatataatgatttatataattgtgaccttctggtcatcgacgacctcgggacagagcagcatactccatacaatgtgtcccgtctttttacgtgtctgaacgaacgcttaatacgtaggaaatccatgattatttccacaaatctctctcttcctgatttgaaggaacgctatcaggaaagaatattttcacggataaccagcaattttgagttctgcaagctgacaggaccggatatccgaatgtacaaaaaaagattaaccaacagaaagtgaggatcccattccatggcggaagaaaaacgaaacctagaaacaatccctgcaggctctcttggcattatctctctggcaggctgtaaaactcttggagaacaggtagaccactacctggtaaaatggcgtcaggaaagagaaagcgagcacaaaaacagccttgcattttccggctatcagcgcgattcttatatcctgcaaagcaaggtgccgcgttttggaaccggcgaaggaaagggtgtcattctggagtctgtacgtggtatggacctttatcttcttgtagatgtggtaaattacagcctgacctattccctctgcggccatgaaaaccatatgtcaccggatgatcatttccaggatctgaagcgcatcatttccgctgtgggaggcaaggccagaagaatcaatgttatcatgcccttcctctatgaaagcagacagcataaacgttccagccgtgaatccctggactgtgccatcgcacttcaggagcttgtaaaaatgggtgtggacaatatcatcaccttcgatgcccacgaccccagagtacagaacgcaatcccgctccacggctttgaaaccgtgcagcctgcatatcagtttattaaaaatcttctccgcaaccaaaaggatctccagattgattccgatcatatgatggtaatcagccccgatgaaggcggtatgggacgggctatctacatcgccaatgtcctcggactggatatgggcatgttctacaaacgcagagactataccaaaatcgtgaacggacgcaatcctatcgtggctcatgaattcctgggttccgatgtggaaggcaaggatatgatcgtcattgacgatatgatttcctccggcgaaagcgtcctggaggttgccgctgccttaaagaaaagaaaagcccgcaaaattttcatctgcgctaccttcggcctctttaccaatggcctggaaggtttcgacaaagcttttgcggatggaattattgaccgtgtcctgaccaccaacctgatttatcagactcctgagcttctggaaagggactggtacatcaattgtaatatgagcaaatatgttgcataccttatagatactctgaaccacgatacttccatcagcgatttgctggatcctaatgaaaagattcagaagctgctgggaaggtatcggtccaatatactttaatgatatgtgatatttaaaaatgtgcttagcagaataagtgggaaagccaaacctttttcctcttttgggattagggtttggctttttttcgtccatggattcaagtttcttcctttatctcctattcctcggagtccgctaatttgagttagcgttgagtcaaaaattgagtcagggtacttcctttctccccttattccacgttacaaataaacgtaaaatcatcttgtttttagcatccagttctgctatacttattaccggtgctaccctacacggtaggcggttgccctcttccagagggaattggatgctatgcatccattaggaccctctgattacatagaaacctgcttgcaggaatccagtacgaaagagggaatggataatgagcgactttgaactgttatcgttggttctgatgattcttgcaatcatcattcctctcctgatagcttacatagaagcaaagaaataaccgccgtgtccctgacaaagatcggcggttatttctaactgattaattgatggggcaaccgtctatcggtagcaccctttatatctttataatagcactccctgtgtcacattgcaagattttcaaaaaacaaattttccattcaggtatcccctgtttctgtcctgacccctttctcctctcatttccctgatctatccagccccctatccttcatctgccttcctctccccgttatctcccttccccaaaagttgagtcaaaagttgagtcaggccttgactttcccccatttcctgttatactaaaaaagccgtaaaccctcataaatactaaggattcgcggcggctaacccgtgtgttcgagaccttccacacgtaaaacaaaactaaaggagaacagaataatgcaaaagaagaacattcaattcctgacccaggcggctatgattgccgccatttatgttgtgctcacatttgtggccaacgctttcggcctcgccaattatgcggtgcaggtccgtttctctgaggcgctcaccattctgccaatttttacccctgccgggattcccggactatttatcggctgtcttatcagcaacatccttaccggatgtgccattccggatatcatattcggttccctcgccacgctgatcggcgcgtttggcacccgtgcgctgaaatccaaccgtttcctggctgtactgccgcctattgccgccaatgcaataatcgtacctttgatattgaaatatgcttatggcctggaaccgctctggttttcctttttgacagtaaccgccggagaaattatttcctgcggcgtcctcggacttctgctggccttcgcattaaataaataccggaaacagattttcggaaactgaatataggaacatagataaggctcctgcgggagccttatttttatgccattctctgtttccggattttttccacaaagggccggatcgtttctgccatttcttccgctttatagtggtgcagataatgaccgcaggcgtactggattaattcacagttcagcctttccgcatatttcttttgaaggggcacccagaagccgcccagctcctttccatccgaacagaataagagaaagggaacctcgggttttctgtgtttcttcaccatctctgcattcgcatatacggatgccgcctcttccagaaccaccttatttaaaaagtttctgttccccagaagttttgcctgccggtattcctcctccgtcagtccttctttacccaccacctgcagcagcggacagcgttgtattccaaaaaaagtaagcattcccataagctttaaagaaccgggattcgctttcttattttcatatgccttgggaaaagccatatccatccccacgattcccataacctcgtcaggatatttctgtgcccagtaaattgcttccagcccggacatcgaatgaggcaggagcacaaaaggccccttttccccggccagacgcagagccagtcgggtttcttccagcatggcgtccagctgtctgcttcgctttttaatctccgaatagccatagccggccttttccactaccacacaccgataacaggatgaaagcttccggtagagcggccggaaatcataaactggcgctgctgttcctcctcctgaaagaaagaccagcgttattgcttcgttatgacctttgccgccgctgccgtcctgctcctcctgtccctgctctttctgtccctgatccttctgtctctgtaccatctcctccggaccttccgcatatacatgcattctgtgcccgttaacttccaccatcgtccccggagccgtcagctgttcctgttctgtatgcagaagcctcctgtgtaccgctgcggcggcagtcagaccgcctgccgctcctgccagtgcccatttccattttttcatatttcctgttcctttccttccttatgtggctccctactttccggccgtatccggaaacttacttttccatggccttccggcgtattttcaatctgtacttctccgctatgaaatctagcgacttcccgggcgaaggcaaggccaatccccatatgtccatcctgagggcggctttccccctccgtatacatgggctccagtgcatggcgcagtgcctgtggggaaaaacccggcccttcatcagacacacagatttccagcaatggcgcctgccatctgcaatggatcactatcctttttccttccggcgtatgctccgccgcatttcttacaatattcagcactgcccggcagacatcctgcctggctaatatcagttccggcaatacagccccttcaaattccgccttcactccgaataccctggctatttcttccgctccgttaaaaatttcctgctgcagcagttcccctgataccggctgcttgttttcttcaccttccgatacattccgggtcattcttttcagtctttccaaatatctgcctgccgcttccgtatttttaagaatggcgctcaaacactcctgctgctcctccgtgagcggcgtttcttccagaagctgagcatttccgcttattatagtgagaggtgttttcaggtcatgaagcagcgcactggtctgggagatgcggctgtgttccatattccactgttcctgcagcgaattacgcagagccgtacgcagctcctccatggaatccataacctcgtcatattcccggatccccgaactgccgaagggctcctccagttctccgcgggacaggctgagcgcggcatcctgcaaaacggaaagccttctgcggaaaattttcacatatcgatgggtcacaagccccaggctcacgataagaacagttccccaaaagataaaataccatttttcaacatctggaatcagctttcttccttcaggattaatcagctccatcttatattggaattgaagaacagcctcttttccttcctcttccgcttttacatggtaatatcctccggaatcttttccggattccctgtattcctccgcggcggcccgttcctcatcgttcatatcggtttccgccagctctccgttttcccatatggcatagctgcataaaaaaggaaccagttctctgcttattccttccttcttcatacgttccgccgcttccgccgccatccgttccccggcatttgcaggatatgcaacgcccttattcacaagcaggttcagccctatccaaaaggacactgcaatcaggcacgctgtaaaaccgcacaaaaacatatactgaatcaatatacgtatcaggcttacgccttttctgcattccatctgtatcctatcccccaaacggtttcaaccggcgatgctccgaaggccgccagctttgcccgcaggtttttgatatgctctgttaccgccgcctcactggaatcgctgtcgtacccgaaaatttcttccagaatctgctgtctcgtatataccagccccggatgtctggcgaacatttcgcaaagctgatattcgctttttgtcaacggcagctcttcttccttcacatatacccgtttcgcctgtaaatcaaagtgtatcctgcccgatacgaaccggtaaacgggcacgcgctgttcccggcgcaggtgggcttctaccctggctctcagctgaggcaggctgaagggcttggtaagataatcatctcctcctgctcccagcccataaagcacatcctcatcttcccctttcgctgtaaggaacaaaataggacagtccgtaaaagaccggatcctggcacaggccgccactccatcctctcccggcatcatgacatccaggattatcagctccgcctggctgcagagcttttcgtccagcgcccgggtgtcatacatcacagtcaccgaatgcccatccttttccagcgcgcgcttcagaagcctgcaaatatcttccgaatcatctgccacaataatcctggccatatacttcctctcccttcttcagcatcacaaaagctgcatcacccaggatatcccgtacaggatatatacatgggccggataaaaccagtaaaataactttttattccccttccctctttgtccgttgtaaagatacatgggtattgccgcaaaaccgctcatccagccatacatcgtagtgatcagcatttccgctgtagctccgggcgtaagaaggaacgggaataccccttccaaaatcagggcgagcacaaaaaatacggccgcctgaagcgcacgtcttttcctgaataaatacagaagaattccttccagtataaagtaagtccctccgtcaataatagcggaatgcatgggaagaagggtataatgcagaaggagcaccgcattcgctgccgaaggaacagcctgtataagccccattcccacaaacggccagatcagaggaagcacaatcgccgaaagccctcttccccattttttctgcttacaccagtcaattccctgcagtatcaccagcaatatggaaaaagtcgcaagcatctgattctggggtacgaagccatccggccttcttacaaagcagatgaaaatatactgcagcagccccatccccacggcaatggcatatatcctgagaaaatactttttacgattccgggtatgttggaaaccttccagcaggcagaacaaaaacaacggagccgataatctgcccagcatggaaaaccattccggtatcttacctgtaaactcgaaaaaataatggatatgatccatgaccatgagcaccagcgctatccatttcagctgaaaatcagtgaatccttttttacatatttcattcttcatatgaaccttcctcctgtattcggaagaatacctcatcataacaagacggtattctttttttgatatacaggagtgtaacaggtaattataaggaatttataaggattcgtcatcctgcagctgtttttctttccgcgtcctgatgaagcctacaatggcgtaatatacgggaaccgttaaaaacagcagccagcccggatgccagtataatgtacccatagatgtggacacattaagaagaagggttccttgaaaatggacactatgaagaagggatgccccctccaaagtggacagattgaaaagggggttctttatctctgatagatgttgatatataataaaaacatctaaaggagaaagatatgcgggaatacacagtaaaccagatgaagcaacttaaggaaaataagtataccctgaatgtcacaaagaacaaactgtatttcacagccaggtttaaagaggatttctggatacgataccaggctggagatgccccgagaaagattatagctgatttaggttatgacactaagctgtttcaacaaaaacagatagacagcattgtgcagagagtaaagaagcaggcgctatctggagatggatttacagagggagaaaatcgaaccaaaagagttcccatgaaacgaataaactcaaatcatgaaaaagaagtatccttagatcagatgcagcatgagctgctataccttcgtcaggaggttgagtttttaaaaaaaaattataaaagcagacaactcaaagcagaaagacggatgatgaatgaatcggactgtaaatttgagattatatacggattagtaagcaaagaagataatctgttatcagttacaatgctttgcgatatagcaggagtatcaagatcgggatactatcgctgggcaggggccgcagatgaaagacagaggaaggaattaaaagatcaggcagattttgaaataattcttggagcgtatgctaaacgtggatatgataagggcgcaaagagcatctatatgacgctgatacatcaaaatccacccataattatgaatgtaaagaagatccgccgattgatgaaaaagtatggacttgtgtgtaaaataagagctgcaaatccatatagaagaatggcaaaagcaataaagaccaatcatgtcgcagacaatctggtaaaaagacaattcacagcttatggagcgagaagggtactgctgacagatataacatatatcccttataatggtgtattttgctatctgtctacaattttagatgcttttacaaaacagatattgtcttatgttttgagcgaatcactggaagttgattttgtactacagacagtaaaccggatggtagaaaaacacggtgtgtcgttaagtgctgaagccataattcatagcgatcagggctgtcattatacaagctgtagtttcattcaattagtaaaggatagaggattgagacagtccatgtcgagaaggggaaactgttgggataatgcaccacaggagagcttctttggccatatgaaagatgaggtggatataagccggtgcaccgtctttcaagaggttaaaacaattattgatgactggctggattattataataatgagagatatcaatggcagttggcaaagctatctccaaatgagtattaccaatatataacaactggaaattatcctcttagaggaataataaatgaaccagaaaaggaagaagaaatataacaatatctattcagaacatagtatcccttcttcttaaatttgtccttgacaaggggtacactttacagagacttttgaatatgccaagaagcaggtatatcatcataataagaacgggaaaggcaaaccatcccatatcttttctccggaaggcctccacacaggaatgaaataagggtatggtaaaaaagatcacccaggccggatgccatgctccggtaagcacaccgattgctataaaggcggcgattaccagcagtgtgaagggaaattccacaccggcccattcccggaaaaaatgagaatcatatctttttccattcacataaatgccgttggaatccagatgaacttcatccttatccttctcgattacatgaattcctttccagccgacatgcacttcactgtctttatccttgcagtggatgccgcttaaaccgatatgtacatattcatccggttctttttccggagacaggatttctccctcctcttcccgtatttccttttcaggcagtttctcttcttccatatccatataggaaaccggaatttcatcttccgtgctcagaagctcatccatggatattccataaatcctcgacagaagaatcagattatccgtatcgggtgatgcctccgcccgttcccatttgctcactgcctgacggctgattcccagcttttctgccaatgcctcctgggacagactgttcctctttcttaaggttacaagcctgttggcaatttcaatattcatgttttaatcctcctgtcttgtgtggaacacttcgttcccgactgtctgcattataaggggatctctcaaagttgcactaccaattctgcttttcattgccgcaactatcggttgcaaaccctgtattatggggatttacagcttatatagcaaggccccattctgccttcgtagaatggggctcatcttacaccgcctgttattttttaacgtatgacaggaaatgacagccggtttcttcaaaccactgggcggcctcattcattcccattttatataccgaacccatttccggattcatcagtactacattcttttcattaaagccgataatcaataccgcgtttccgtctccgagaatagccagaacaggaatttctctgtcaggataatacagtacactttccagactgcagcctgacaaatccaggacctgcataccatccagattttcttcaaggacctcctgtaccgtttttccctgtgcaagcagatattccgaatttctcataataccttcataagagaatagggaatccagacagacagcaaggctgttcttttcctctgttacaggaacgccttcgatagccatgatctggtttttcacattcagccggcctcttcgccagatataggcgccgctctctcccatcacagtgcccgctatatcattggccagattgatcgcctctcctgccgccgacataatcgtcacctctccgcccggactgtatacataatagctttcttccgctatctgggactgaggtatctgaatttccctgctgccttcatacaggacttccttaggtgtaaggaacttgagtttcttgccgtcgaggtcggacttcatctggatttcggtaatatttttatattcctccaaaggaatagtaataatcttattgcttctctggacatccaccacaccgcttacaatctggtcattctcacaggggacaaaatttccctccccatccttttccacacgatccaggatgatctggttttcattcatgctgcagccggtcacatatacccctgatttttcataggtcttcaggacttttccattctcatcctgaattttaatctgatacatgggaaataccattttgccggtatcatccaggcttacatcggatatccgggccatcccatataccaaatcctcattcataaatccaagggccatgatataattgccgcttcctgcatctattgtcacctgttccgtactgtttaaattcatcagggtaaggctggtgctttcgtattttttcccctgatccggccagacaatcatccggttgctctccgatacctgataactgtcgccgttcaggttctccgccaccacctccacggtctgcctgtcaagatggatgcagatgaactgattgtccagaagcatatagagctcattttttccgttgacataagccagctgttccacttccgccttaaatatttccggagccttcagggtgggaataaaagccagttcctccaccgtattcagggaattgttatacagataaacctccgctcccgtatagccttcccttctgccccggcttatatatccataaaccatgaagaatacatttcccgcttcatccacctggagaattttaaattcatgcccgccgtaaaaggaacgctcatcctttccgtttggatcataaaaggaaaataatttggacagcttattatcggtcatattcaggctgtaaagcacgccggcctgcgcaaaggctagaattttccctccgtcgctttccatcatttccacattcggatccgtgattccaagcgcaattttgtctcctacaaaagcggatttatcttccgaaaaaatatcactcatgcgtctttcaaaatccagcaggtacatggtcccgtctgtcccctgccggacgcggtagacctcatccaccacggcaaaggtttccttttcctgacgcatatagctcactatatattccaccgttacagacgctgtctgttctgtgatatcacggatagtaaagaccggctccgtgagctgttccacagtcagtccggcccagccgatctgggaggcgctgctgtgtatgttcaccttgctgagagtggaattatctccttcgctgttgggctccagattgccctcgaacccggaaggccagtcctcatggaaggtggcggcgctgaaatccctgacaaaagccagcttttccttcacgccataaccgtccgcctgtatgatcctggtataatacctggcgcatctgccgtcctccaggttcagaagaaacgtcaggctgtattctgtcttctcatctatcaaatccttcagcacgatatctgcggtgatgttttctccgtccatacgaaagttggtgatctccgtattttccaccagccggcttccgtccacgcttcttacctcaaaggccatggaatccacggtctgatcatatttttttacacttatggaaagctttctgtccgggccgatgggcataatactttccttcatatatttttcttccataggagaaaggaagccatgcatcatattcacatgttccccgcccatatttatataaacgagaggcagctccggcagcttcatttctgccgtcatgtccgtatttcctttattcaaaaacaggctgctcattaaaagcaccacaataaatgttgctgcaaatacgcatcccttgataattgtcttcttcattcccattcctttttatttgcctacaggcctctccagcagctcctgcagacaggtatgcacatgcaggaagtctgccattttatttattcccgtatcaacaggctttccgccgtcccgcttcacagcccggatcaggatatttttaggtgtatgctccatatctatgaattccagcagctgggtatcatatcccgcctcctccagcaggtttgcgcgcagcgcatccgtcagaagagcggacatacgctccttcaccaggccatatttcagggccggctgaagagcctcgcattggatctgccggttcatttcatgctggcagcacgggacggaaaggatcactccggcatcccagcatatcgctttatacagcgcataatccgtggcagtgtcgcaggcatggagggtaaccaccatgtccaccttctcctcccctgtataatcagcaatgtccccctgcataaattccaggccggtatatccgtatttctccgccagcttactgcaattgcgtatgacctctttcttcaaatccaggccggtaatgcggatatccagcccgcagagctcatgaagataataatacatggcaaaggtaagatagctcttcccgcagccaaaatctatgattcgaacacatctctctttaggaagtataggcataatatccgcaataaattccaggaatctgttaatctgcctgaatttgtcataacggctttttataatctgcccgtccccggtctgtactccaaggtccttcaggaacgcaaccggacggccttcctcaagaatatattttttcgtcctgttatgggaaagctcccggccttcccttttgacgctgtttttcttcttaatggtaatctttccttttttgctgaccagaaccattgcctggtaatccatagtctccacgtccatctgacggaaagaggaaaccaaagcttttcccactttttccgccgcctcaccggcagtcaggttttcatggaatacctgatttccccgaaagctctccagctgaaaataaatttctgtctttatcattacaggcctcagcttaaggcggatatccccatccttattcctggggccgccaacactgagctgatataatctttcattcaggctttcttctaacagcttgtataattcttccatccaaagtacctctgtttttcttttcttcctcaaacattcctgcggatgtttttatacgacaggatcggcaccctatcgtataaaaacaagccttccctgccttgctgcaggctgaaagtctgaatctattttaattcctccgcaaaaaaaccacaactagaattttaaaaagctgttatttcttctgccctttgaagaacaaatcccgcaggagcctcccctgccatgtcttcttctgaaaatttcataataaagaaggacctgaatcaaatcccctttattccggcgatccgtttccctgtgggaggtaacctccatctgccgtttttccgcagaagggatttcttcctgcgttccctccgcgcattttccgggttcctgagccggtatctgcaccggttcctgattctctgtttttctgttttccatgaaagcatttgcaggaatctggcccgaaagctccgcacgttcctcttctctcaatatcttatcgattatgccctcactcagacggtacatagccagccgatccggatattcatcataaataaggcttccgttataatccatagtatccaggatatccatgatcttcttctgataacggcgggcttcctccggataaagctgaagaaaatattccagatcccttacggcatcatcctcgtcatcccaatacatgggcataggataagtcatataaaaaggaagcggcttttttgtgctgccgcagcctccgaaaggacagccgtaatccatatttcctcccatgttcctccattcatcctgaatcccttttcccccgtactctctgtagctcttctggcctcctctgtactccggcatattccgccctttatcttcattgcggtaaggctcttccggaaatcttcccgggaatttccttatatcatccatcactttccctttccgaattgttccgcccctgaagacagtctcaggcgcttcacatccaatcgtctttatcttatgttatgcgatcggacaggaaagggtttatatcgatttctttttaccggcaatcgtatcggctgcatgcacggccagttccgcttcttccttgctgcaattgccgtaatacctcgctttttcgtaaagccggagcagctcgtccactgccttttctttttccggttcaggcgcaggaactgtctccagcagctcccttgcggtcctgcagtcctccggcgctcccagctttcttacggtacggataaaatattttcttatcttttgttccggtgtcctggtcagaaaaggaaaaggcttttccttctctttcttttttcttttccggtccagagactccctgatctctgtggcctgtccttcttcctcatcctgcacgatacctttttcataaaatttcttcaccgcggcaagcaccagcctgtacagcagaaaacaaatcagggcaatcgtcagcgctgccatcagatattccgttattttaatcaggatatccagccaggccggcgtcgcagccgcttcggacaggcccatatccatctgcccggccgccgccccttcctcaatcatttctccctctttcccggaaaaaagattcagcagaaagctgatacatacggcaatggccctggcgatataatacgccgccgttttcaccagatccatcatgccccggacaagccggttgttggttcccgcccccaggatacatacggcaatcaccccgaaaacagccgcaagcccgccgccctgcaccagcattttacgtacagggatatgggcgttgctgctgcggttgaacttcacaaactgcaccagatgctccaggtaggcgtaaacaaaataaaaaaaggtgtaaataagggccgtattcactatccggccgcaggctgtttcctgtcccagataggcacacagcagaaaggagcctcccgctgcaatccctcccgcaacaggtccaagctggccttcccccacctcctgcctggaaatccgaagctggaaggagcgcaccagataacccgccgccagaacaccgaagaccactctctgcatgacaccgtctcccaaaagaaaaacagcggcggcagccaaaacggcatgacaggccacaaacgtcaggaaatgccccgccttttcccgtatgagcagaaaaagcaagggtactgccagaaaaagcagctggcgcaggattcccggcgttttcaccaaagtgcctgtctctcccacgagcccttccagattggaaaaggaagaaaaaaccactgtttccaggcagaatatcaccaggaaattcatcactacctccagtatctgcatactatatctgagccgcttattttccattcagcatttcctccgcatccaatctgataaaatgcagcgcttcttcctcctccacatggctttccatccggggaaaaagcggacacatccaggtaaagtccgtgcccattcgtgcaaacgtccggatatcctcctgaaattccgggcttctgtccaccgacaaaaacaaagtagccatatccttaccctcttcctccagttctcccctgaaaagttctccgaagggatataccccttcctccaggctgattctggcaaaggccctgtttatgctctccatatggcccggtcccgcgctgggctgcattttcatggggtcgcctgtgaggacatcccttccgttggcataaactgcaacacggatcccctgttccagcagttctcccgcaaaccgggcggcgatggatatgcacagctccaccagctgttcatttttcaggattccggtatccgccagattcaagaaaatccgcactgccctgagcgaagtataatttcttatattcaccatcaaatcgcctgtccgcgccgtggccttccagtttatcgttttcatctcgtcataaggcgcatattcccggatcccccgatattcaaaaggatcctccagcatatgccttttggccaaaatctctccgttcagcttctgcagagcgctgtccagctccacaccggaaacaggggcaggataaacatacagtgtgctgtccgccgtggccgaggatatcatttcccttgtcagaaataaatccgccgccaccagatccatctcccggagcctgaaatacccccttgccccgcagacaaagggaattgtccttatgacacgctgcctggggcccagcgaaaggatatcgttccggtagtatttgtcggtaacagccccgtccccttcgtcggaaaaccgaagcttcctggaaacctgaaacttcaccttcagcatggggagcgggagaagctttccgttctccacccgctcggaaagctggcatacttccccttccaccgcactttctcttgaaaaggacagctctgcggaaagatccttctcccaataatggccatagatccatttttgaagataaaacagaaatacggcgccaaaaacaatccagattatcagcatggctttccccctgtggcttattttctgctaaagtcttctaccggaacaggaaccgctgccaggatatcctccagaagcttcacagcttcctcctgcctgctccttccaaaagaaaataccagcctgtgagccagcacggaggatgccagcttttttacatcatccgggatcacataggctctgccttccatacaggcccgggccttcgcgcagcgcatcagtgccagcgtgcctctggggctcactcccatgacaattttttcctgcttccttgtcgccagggcaatatctgccagatagccgttgacaagaggatgtacataaaccctttccgcttcttcctttatggaaagcagctcctttttggacatcaccggcttcagctccggcaggggatccttatccttataggtctccagaatccggatttcctcttcccgatccggaagccccatggaaagcttcatgataaaacggtccgtctgtgcctccggcagaggaaaggttcccgctgtctccaccggattctgggtggcaattacaaaaaacggagcatccatctttcttgtctctccgtctaccgtaacctgccgttcctccatacattccagaaggccagcctgcgtcctgggcgtcgccctgttgatttcatccgccagcagtatattggtaaaaacagggccctccttccagacaaagctctctgtttcccggctgtaaatgtgcatacccgtaatatcagcaggcagcatatccggcgtgaactggatccttccgaagtccactccaagtgaagcagacaaagccttcgccatctttgtctttccggtacccggcacatcctccaaaagcacatgcccgccggccagaagcccggccagaagcttttccagcacctcttctttcccgataatcacctttcccacattttccagaaccttacttatatcctctcgcatacgcgcgcctcccgctgcctgtattatatacccatatgtaatacccgaatcggaacgaaaaagcaggcatactcccaacgggacgattttccccgtctggctacacctgctttctccccctttatttcaaaacattaatacgtgccatcgctctttccaaagccgtttccgcccttgccagatccgtattggattcatggcgtttgatacgttcctcagctctttccagcgctgccttggcacggttttcatcaatttcctcaggccattccacaacctctgcaagaactgtcaccttatcctgcagaatctccacaaaacctgcatgcagcgcggcttcccgcctgccctcttcggtcgtgatcgtgagaatgcccggtttgatcataacggtcatagggatatggcccttgtagataccaattgccccttccgtggtattgaactccaccatgcttaccggaccttcataaaaaattctttccggtgtgatgattttcaatgtaaagttcctgtcttctgccataaccgctcctctatcttactcatgcgcaagtgcaccggcacgctcccgtacatcgtcaatacttcccgcattgaggaaatagctttccggaatatcatcatgctcaccgtccagaatctcacggaagctgcggatagtttcagaaataggaacatattttccttccataccggtaaactgtcctgccacaaagaacggctgggaaaggaatctctgcacctttctcgcacgggaaaccaccagcttgtcttcttcagaaagctcgtccatacccaggatagcaatgatatcctgcagttcattatagcgctggagcagctcctgcacgcctctggccaccttgtaatgctcctcacccacaattctggggtcaaggattctggaagtggattccaaaggatccaccgccgggtaaataccaagctccacgatggaacgggaaagtaccgtagtcgcatccagatgggcaaaggttgttgccggcgcggggtccgtcaagtcatccgcgggtacatatactgcctgtacggatgtgatggaaccatttttggtagaagtgatacgctcctgcaaagcacccatttctgtctgcagcgtgggctggtagcctactgcggaaggcatacgtcccagaagtgcggacacttcggaaccggcctgtgtaaacctgaatatattgtcaatgaacaaaagcacgtccttgccgcccttatcacggaaatactccgccatcgtcagaccggaaagccccactctcattctggctcccggaggctcattcatctgtccgaaaaccatggtggtcttgtctataaccccggattccttcatttcataataaaggtcatttccttctctggtccgttcacctactccggtgaatacggaatatccgccgtgctctgtagcgatgttacggatcagctcctggatcagaactgtctttccaaccccagcgcctccgaaaagaccgatcttaccgcccttctgataagggcaaagcaaatccacgacctttatacccgtctccagcagttccgtttccgtggactgctcttcaaattccggcgcaggcctgtgaataggctcatagctcactccggtcggagccggaagattatcaataggctcgcccagaacgttaaacatacgtcccagggtcttctctccaaccggcacactgatgggagatcctgtggcaattacatccatgcctctcaccagtccgtccgtggaacccatggcaacacagcgtacaatatcgtcacccagatgctgggcaacctccactacaagcgtgccgccgcttctggtaggaattttcaacgcttcgtttatatccggcagacagtcctgttcaaatttcacgtccagaaccgcgccgataacctgcgtgatttttccgtttttattctctgccattgttgtttcctttcctttatttttaccagcattaactgaacacaagcgctcactggctgatcgcaagcaatcattaactgatcgcaggcgatcattaactgattgcttgggcgcctgctataatttctgtcagttcctgggtgatggagctctggcgggctctgttgaacgcaagcgtcagatcgtcgatcatatcctccgcattgctggtagcagaatccatggcctgcatcctcgcgccgttctcactggcagaagcctccagaaggcctccgtaaatcatactggtaatatatttgggaatcagcagatccaacgcgtccacttcttccatttcaaaattcatgggcgcttccggccctgtaaatccttctttctgtccggcagccttttcccctgtaaccgtaccggaatcagatacgcctgaagcagaatccttttccgatgaagacggctccgcgcttacgggcagcagcctgttcataacgggaatatgcactaccgtatttttgaatactgtataagccaggtagatttcaccgatctcaccctgttcaaaagcctccaatacacgccttccgatatgcatggcatcgtggtaggagggttcatccataacctccgaataatcggcggcaatatggtatccgctgcgttccagcgcatccttcccctttttcccaaccgcataaaccaccacatcttccttgggaagatcgcctcttgtgagaagcttggtaatattggaattatatcctccggccaggcctctgttggaggtgatgacaatcaccccttttttgctgcctgtgccgccgtccaggtaggggtgcctgatattctcagacattcccagaatggactttaccgtctgatacatggtatcgaaatatggcttggactcctcggcttttgttttggccttctgcagcttgacggtagaaaccagcttcatcgctttcgttatctgctgggtactctggatacttcccttccgtcttttaatgtctctcatggaagccatacaaattcacctgttctttctatctgaattgtgccttgcactcttcaatggccttgatcagcgctttttccgtatcctcagagatcaccttttccgttctgattgcagcgggtatctcaggatacttcacattcagaaattcaaacaattcgctttcaaacctggtaatttccgttaccggaatatccagcaggtacttgtttgttgccgcgaaaataataataacctggtattcaacagccatgggcttatactggggctgcttcagaacctctctgattctttcgccctgtgccagcttctccttggtgtccgcatccagttcggatccaaactgggaaaaggctgccagctccctgtactgtgccagctccacacggatgggggcggctatttttttcatcgccttaatctgagcggctccgcctacacgggatacgctcaaaccggcgtttactgccgggcggaaacctgcattgaacatttccgtctccagataaatctggccgtcggtaatggaaataacgttggtggggatataagcggaaacgtcacctgcctgggtttcaatgataggaagagctgtcagggatcccccgccgtactcctcattcattctcgccgcacgctccagaagcctggaatgcagatagaatacatctccgggatatgcctcacgtcccggcggtctcttcagcagaagagacagggtacggtaagccgcggcatgcttggtaaggtcatcataaaccaccagcacgtccccgccgttttccatccattcctcaccgattgcacagccggagtaaggtgctatatactgtaacggtgccagctcactggcagtggatgccactaccgtggtataagacatggcgccgaattcttccagggtcttaacaattgatgcaaccgttgaagccttctgaccgattgcaacatagatacacttaacgttctgccccttctgattgataattgtgtcaatggcaatggcagtttttcctgtctgcctgtcgccgataatcagctcacgctgccctcttccgatgggaaccatggagtcgatggctttgatacccgtctgcagaggagtatctactgattttctcgtaataacgccggacgcaaccctctcgattttgcggtatttgtccgtctgaatgggccctttgccgtcaatcggctgtccaagggcattaactacacggcctgtcattgcatcgcctacaggaacctcaaccaccctgccggtggtcttaaccatatcgccttcccggatatttctctggctgccaagaagaacggcacccacattatcctcttccaggttcaataccattccgtatacttcaccgggaaattccaaaagctcaccctgcattgcgttttcaagtccgtggatacgtgcgataccgtccgcaacctggatgaccgtaccaacttccgccacttccagcttggaggagtatcgctcaatctgttcttttataaccgagcttatctcttctggttttaaattcatggactttcaaccttcctcatattccgcctcaggggcggttttccattttcccgcatacacgggatcctctttatgaaagctgtaccttcatcagctgcctctgcagcccttccagcttcgtacggatactagaatcaaccaccctgtcaccaatccggataaccagaccgccaatcagatctttatcaaggctgtaatgcagctccattttactgtactgcgtggtttctatcaggcgtttttctatcctggccttctgtccgtcggtaagcgccccggcgctggtaacatatgccaccccgattttgtggaaagccttgtatctgtccgtatagtaagtaaaaatatcatcaattgcgccgtaacggcccttgtgaatcaacacctccagaaaaccgtataaagtatcggaaagctttccttcaaaaacattgtgaaggatttcaatcttttcatcccttccgatatccggatgattcatcaggctggaaaacccgggattctctttcagaattttccaaagagaatctatctcatccataagactgtccacgatttccttttccattcccaggctaaacagcgcttctccgtaagtctccgaaactagcttagccatgtgctatcacctatttccttaagagtttcatcaatcaggctgtcctgagccgcagcgtcgatggtattcccgataaccttgcccgcaagcacgcttgcaagggaaaccatttcattcttcacctcatcagccaccttcttcttctccagatccgcttcaattttggctctggctacaattctggcggcttcagccctggcctccgtaataatacgggtttcattggccgttgccttctttctggtagcgctgaggatttcatcagcttctttattgatgtttgccagcttgtcctcatattcctttttcagagcggcagcttcttcctggctgactctcgcttcttccagttcattccggattttatcctgtctttttttcaggaattcccttgccggattaaacaggaaataagacattgccagaagcagcacaaatacggctattatagacaatacggcgtccgcgagcagctggaaatccagatcaaaaagacggggcgtcatttcgtcagcagtcattaatactgccatcactaattttgtcgtcaagatgcaggcctcctttcatttctatttttgattgaggccgcaccttaaatcagcggtttaacgaacatgagcagcatggcaacaagaagtccgtaaagacctgttgtttcagcaactgcctgtccaagaagcattgtggatgtaatatcagatttagcgccgggattgcgtcctactgccgcggcagcgtgtcctgctgcaataccctgtcctacaccaggtccgatacctgcgataaccgcaagacctgcaccgattgctgaacatcctaaaataaagctttcattgaactccataatttcctccattcttccgcctaaaagcggttttgcattatttttcatctatgaacaattacgccggttccttcctgcgctgttgtttcccctacttatctccgatagcatctgaaatataagtcatagtcagcatacagaatacatatgtctgaattgcgccggagaacaggtcgaaatatacgtgcagcgctgccggccatatcactgcaaaccattttaacaatccgtataccagagccatcataacggtaccggaaagcacatttgcaaaaagacgcagtgacagggatatgggaactgccacatcaccgataatatttatgggtgcccagataggccatggttcacaaaggcctttcaggaagcctgacaccttctgatacttcagtttattaaagaaaatcagagtaaacgtcaaaagccccagaggcagtgtcacgccatagtccgccgtaggcggccgcaggccgaacaaacccgaaatgttgcatatcagaataaaaataaatatcgttccgatataattcgcaaactttacggcctttttgcccattacgttgtttatcataccatccagcttttccacaaccatttccacaatgttctgaaaaaagcccggcacttccgaagcccgcttcatcgcccggtttgcagctatggcaaaccctataagcacaagcataatgatcagcaggcatacatgggtggtggtaatccacaccttatgtccgaagaaactgtaagaaaagattccatgtatcataaaatccacttccgaatccgcagacagcaaaataccattcattataaattcacctccttcttttccatattttcggcaccgtccgttccgtcggggtgcccgttccattcagggggatcctgaagcacaaacgcctccccttccccctctttatcaggatgcagacgtctgtgcacaaaaggctgcagataagccgccgcctttaaacccataattcccagaaaaaccgccagcggattagccgctctcgtcagcattaccaccgcaaaaaccacaactatcacggcatatctgataaaagccgttttcctgatatagccctgggctgcgcctcccctgctaagcccccgatcgagggcccaccacatatggaaggccgaagcacctgccagcaggattcccagccataatcccagactgtaatccgccttttcctttaaaaaccatacagggatcaactgacagacgatcccccacagcagtatgcccgtccataattccaggacagtttcatttactttttccagaagatttttcatcatgactgcctttactcttgtccccagttaatttttgtgccaatacatatatgttcctgaacccggcaagcgcaccgacaaagaacagtataaccataaaaaaagatgtgccaagctttttatccagaaacatgcccgcaaaggagcacaaaaaaatggggaccagcatataaatgccaaactgcgttatcagggacaaatacctgaaaacattcttatccacttctgtattcctttcgccgattatacaacactaaccccagggtaaaaacactcatttatgattatacccattttcatggtttctgtctagcaaaacagtggtttttttcattgacattttgtccggttaagagtagtattttggacaaatacatacttcattttcaaacctttggcataccctgaacagacgcagtccctgcgtcccaaaggaggaggaggcgcttatgaaagatcccatcctgtaccgcagacgtctgattcccgaagaatgcgttcttctgaaggatgacaggattcttctgcatgcagacaacattctggtaaccagctggcaggcgctgaaaccaagaaaggatcttcaccacggctattcctgctattttttcaaagaaggctacaaaatcagcaaattctatgccgcagacaacaccctgctctactactactgcgacatcatcacccacgactataacgaaaaaacgaacaccctcatcgtcacagacctcctggcagacgtaatcatataccccgacggcttcgtcaaggtagtagatctggccgaaatatcccaggccctctcagccaacctcctaactatcccccagctccagtccgccctcctctccctcgacgccctcctaaacctcatctacgccggcaaactcgaagaactgaccgcccccataaaccgcttcgacccagcccaaagcctgctccttcagcaataaaccatttattaacaaattcaatcttctaccacacaaagccaaggcgaaaaccaccattccccgccatggcttttttattaaacaatcaaaaacctacgcctgccagctcccccacgttttcatgaaccggtctgcctccagccttcggtcttcgtccccgtgcattctgtctcgacaggtgcatctcaaaaaaagggagctgtttcttaccgttttgatcctataatacattgcccgcccttagcggcgctgtctgacgaccgaagggaggagtttaagccgcgttggcaatatattataggaacaaaatggttagaaacagcccctttttttgtctgcacctgccgagacagaatgcacggggacgaagaccaaaggccggaggcagaccggttcatgaaaacgtgggggagccccccccgccccattttttaataaaacacatgccccccaatattgataccctccagccccggaatcggcgtcctgaaatacacacaatttcccacattggtcattcctctcatcgcctcatccgccgcccggtagcagctggccgtcgccctgttttccgcaagggcaagagcaagacgtcctgtggacaccggttcaaactgccggttctgataaacgacaccagaaagagtgctgggataaacggaactgagcacacggttgatgaccaccgcgccaaccgccacctgcccgtcataaggttccccgcccgcctcacaataaatcagattggcaagcagatatctgtcatcctccgtaaaggaaacctcggaaatgtcacgccagctggaattagccgccagtctggattttgccatttcttccgcaagctgcttctgaagagcggatatattcttattctgctcctcaatctgtgcctcaagcgccgcaacctgggcctctgcaccggcaatctgattggaatagctgcttatatttccctttgttttattaatcagtccgctgaatttttcatgctccgcctctgcggaagccttcatttcatccagctcttccttttccttctccagacgtgcttctgtttcctctacctgctttcttgtttccttgtactgggcaagcattttctgatcataggcggcaatctgctcgaaatattctgatttgttcagaaaatccgaaaaggaggaggacgaaaacaatgcctccaggtacatctggctgttttgctcatacatgaactgaatccgctttttcatacaggtatactgccattcttccgttttcttggcttcctccagctcttcctgcgtcttggcgatttcatcatttttagcgataatattgttttctatggtttccaggttattgctcacttccgtcagctgcgtagtaagcccggccagttctcctgccaggccggtcttcgcttcttccatattaccaatattggtttccgtggcatttttctgatcttccgtggcctgcttttcctgcttcgccttttccagcttttccttcgtatcagaagtggctccagcccggataaccggaatgctaaccagcaacacagccgtcaaaacccctgtaagcagccttcgccttccagctgtcttcatcccatctctcctcttataattcaattgtcacattacggcccgcagattcatactgacggtaaaccacccccgccgcatccagcatccgcttggaagcgcgcacagccggagtatccgcatatttgtcacattcatatataacttctttgataccgctctgaataattgccttggcacattcattgcagggaaaaagggaaacataaagctttgccccggcaagacttcctccccggtaattaagaatggcattcagttcactgtgggtgacataaggatacttggtatcctcttcctccccctttttatcccatgggaattcatcatcggagcagccgatggggaacccgttataacccatggaaagaattttattatcctggctcactatgcacgcccccacctgggtgctggggtccttggaacgcatgccggacagcttggccactcccataaaatactcatcccaggttatataatcggtccttttcatgaaaattccccttatttcttttattttgtaccaaaaatcctgtctccggcatctcccaggccgggaacaatatagccgtgatcattcagcctttcatccagcgctcccacatacagatccacatccggatgcagctcctgcatcttcgcgataccttccggcgccgcaataatgcacatgaaatgaatctttttacagcctttatccttcagcatctggatggctgctacggaagaaccgcctgtagccagcatgggatccacaacgaaaacctctctgtccgcacagtctgcgggaagcttgcagtaatattccacgggttccagcgtttccggatcacgatacaggccgatatgcccgattttggctgccggaatcaggttcagcacaccgtccaccattcccaggccggcacggaggataggcacaatcgccattttctttcccttcagctccttcactgtggtgtcacagatgggtgtggtgatttgcacatcagccagcggcaggctccttgtggcctcatagcagatgagcatggcaatttcactgattgtctgcctgaaatccttggtgcccgtttcaattctcctgatgtacccgattttgtgctgaatcagcggatgatccatgattactacctttgccataatatttgtcctcctgtatgtttttatacctttacctatcttccggcatccctgagggacatatccgcgtcccttttatcctttttattcaatagcctttacccttcgggcatgcttttcttcccctgaaaaaggagtgttgagaaatgtttccacaatgcccagagccaggttttttcctattatgcccgctcccatagccagcatattcgcatcgttatgctctctggtaagtcttgcagaaactgtgtccgcacaaagcgcgcagcggactcccttcaccttattcgccacaatggaaataccgatacctgtggtacagataacaattcccatatcacactctccgcctgccactgcttccgcagccgcccttccgtattccggataatcacaggactcctttcccatacatccgaaatccttaaaagcaatccctttctcctttaagtatccgattacttcctgttttaaatcataaccgccgtggtcacttcctaatgctaccagcataaacgcacctttccgccttccggcttttattatttgaatgataattgcttatccttccatcatactgtaatgatacggtgtcccgccgctttcagcagccggttcataatcgcctgccccattccataggaagaaaaggattccgtatacatcacttccacctcttcatcatcaaattccctcagaatccgatacaggctgtgggcaatggcttcttcatcctcccggctccccacgctcttcacgctgtcggccgcataacgggcaaaagtctcatccgttgcgataactcctgttttctttccttccgccgccgcacgggcacaaagactgttaatatgctccacaacagcctctgcactgccttccacaatggaaagctcacctttgggtgcataatgcctgtatttcatacccggggccttgggacgctgtgcagtggtcccgtccagaatcgtctgatccaattccacctctcccagcaccttctccagcatttcctgcgttacatagccgggacgcagaatgatgggttccggccccgacacatccacaatcgtggattccaggccgattcccacggctccgccgtccaatatcatttctattctgccgttcatatcctccgccacatattccgccatcgtggggctgggtctccccgatgcattggcactgggtgctgccacaaagcctccggccgcttcaataagcctccgtgccaccggatgggatgggaaacggatcgccaccgtatccagtcctcctgtggtttctttgggaaccgtatcctttttctgcagaatcatggtcaggggccccggccagaaggcttcggccagacgttcgacctcctccgtcacgggctccgcaatccggtaaatatcctcccatctgcagatatgcacaataagaggattatccgaaggccttcctttggcctcatatatttttttggaagaatccggattcagcgcatctcccccaaggccataaaccgtttccgtgggaaatgccaccagaccgccggccttcaggatatctcctgcccggcggatttgctcctcatccgcattgtctccttttatcaccgcatatatcgtatccatagtaccgcttttcttcccctttccaaaagggaaactttattccctgacgcctgaaaatccgccgacaggcttacttcctggacattataccacattcagtactgatgtaaaaggaaaaaaagcccggcgctttttataaaaccgaataaaagcggccggacttttcccgagtcctgccgctttcttaatacttccctttttatttttttaccaaagctgcaattcctgccggccggcaatttcatacagtgagcccttccagtatacacttgcggataccccatccggtaattccacacacatcctgcccccattccggattattttcaccctgcccatgggtgtattatgccatgcactgaattcttttacacggtccgaaaagcagggtctcagtacaatccggctccagcccggttcgcattcctcgggaacaagtcctgtcagcgccttaaacatccatgctcccacggtggaacgcatatgatgattcagggagcccttcttcccgctccaatgctcccagagagtgcctcctccattctgaagcataaaggcccagcccgggaattctttctgtcccgctatcttcagcgcatcttcctgatatccgtaacgggtgagcatttccaacgtataaaccgaaccgaaaataccgcctcccgcccggtgccccttcctgcgcacaatatcggctaactcttttgcttccttttccggattttccgataacccgaaaaacaggacacagctcaaataactctccgttctattgcaggatccataataatccctcaatatcgccgcctttacataatcggccagtgccttccactccttttcatctcctttttggagaagtgcggatatctgctccataatctgtgccatacgcatcacaaagcagctcagtatcatcccggcagggcatacctcctgtgattcatccggcaggaagtctcccagcccgcttttacagattccgtcctccgatatctgctgtgtgtaacgcatgtattttttcattgcttcatagtaacgctccggaatttcttttttccccgtaaaccgatatagctgccatggaataaaaatcagcgccccatcccaggtcggcccgctctgatagttatatccatagacgcttgtaggcgcaatacacggaagctgcccgctcggccactgacaatccgccagactgtcaagatactgcagataagcatcctccatatccagattcagcagggcaaattcacaggacatatgggcatccccggtccatccattcttttcccgatggggacagtcagtagggatatgatggaaattggtttttaccgaccacagcgaagcatcatatatactctgcagcacaggatccgaacactgaaggccccctgccgttttaaaatccgtataaaatacacgggctctgatctgccggacggccgcctctcccttcacctgtacataacgaaaacctttataactgaattcgggatgccaggattcctcctcatcactcccttttcgataaaaatcgatctggtttcttggaatgtcacaatggcgtttaatcagcgtctgatcgatatttccctgtccgtcaagccgctctccatacaggatttccaccgtatcccctttctgaccatccagggttatttccacatccccggaaagattccgtccgaaatcatatactccgtttttcaccgataccggctgtctgtattcctgaatccgtattcctggcagtttctgctctttcaggattccccccggtcctttggcaattaccgcctggctccattccttttcttccgctccggcatcatagttttctccgaaacgtacggaattataactccactttccttccctgcactgccattttgtatccgaccataagataaactgaccgtcggcgtaaatctggcatatcagctgaagatgattcttccacaccgcatgttcaaaatcaaagcaatcttctcccggctcatgaaaccagccgtttcccaaagtcacctctatttcattgcttccctctgtcaaaaattccgttatatcacaggtattatagagcacagtcctgtcataagcggtaaaagcaggctgcagaagttcctcccccacgcgcttcccgtttattttcagataataaaaaccaagtccgcagatatctatggatgcgctttccggtcttttcgccaggctgaaaatccttcgaaaaaccggagtgacattttccggacacgtttcaaacataatccatttggccttccattctttcataccagtctcctctatttcatctccggatactcccggaaatagcctgccgcttccagttcacacagcagctgctgtttttctccgtcagataaatccacagccggtttttccgcttttcccaaagaaatcccctttcggttaaaaagaaatttcatagcccggatctgcccgtattttaaaagaacttcgatgatattgtccgcctggaactgccaattccgggcagaccgcatatcacctttcctgaaagccccataaatctttttgtaaatacccggcataatgttataggtggaaccgattcccccgtcggctcccataacaagtccgcaaagcagcgtttcatccggcccgttcaaaagattgatgtttccgccctgaagcctggaaatacgaaacagctcataataatcattcctggtaaatttcatcccgatcacccctggcagctcaaggactttttccatcaggaccgtcggatcctgttcccccagcatataattgacatagaccagcatgggaatatccacggcctccgacagctgtctgtaataatccactgtttcttccataccatagcggtataccggaggaggagtcgcagatatggcatccgccccggccttttccgcctgtctggccagccggatcccttctctcaccgaatatgccccaatatgtacaatacaacggccccggccgtctatggccctcagggcctcttttgccagctcttccctcgcttccgtttccatactatagcattctcccgtagctccccctatataaaatccatccgctccatgatacagttcccagtcaatgagctttttcagcccatctctgcggataatcccctcctctgttatcggagtgagaagagcgggaaaaatccccttaaaaatcttgttgctgtcccattcttttttcattttggcccccatctgtatgctttgacgtatttttcagcatgtaaaactacaaacatccttccttcagccctttaccccgccaatcgtaatccctttcacaaaaaatttctgacagcttaaaaagataatcagcatgggaagcgtggctatcatggctgccatcagctgatagcctgtattggttatctgaccctgggaaaacaaagcgatcccgataggagtcgtccgaagccctttatccgcaatcataatcagctgccacagataatcgttccaggcgctgaaaaaagaaaaaataccgagtgcaccgagtgcaggcagagccataggcagtacaatcccaataaatctcctgatctctccgcatccgtctatctccgccgcctccagcagctctgtcggaatgcttcccataaactgcctgcataaaaacacaccgaatgcaggagatacggtagtcagtattaagcctatccttgaatttgtcagatgaagcttcatggccacaagataattgggtatcagaagcatctgcctcggcagaagcatggtggcaatcacaagggcaaaaatgagctcctgcccccggaatctttttttagcgaaggcatatcctgccgttgcaccgataaaaacagtaataatcgccgttcccagactgaccgccgtactattggcaagccataacagaatctccgtcttctgccacacataagcggcattttttcctgtcaggttccgaaaaggattcagatccggaggtatgagctgtaaggccatctggcttttaaaggctcccgttatcatgacataataggggaataaaaaaaccagtatcagcagtatcagcaaagtaaatgacacccattttcctattttcttagtcttcataatccctcctaatactctacggcttcctgcttcatcatgcggaattgaagaaaggcaataaccgccgtgattaaaaacaggataactccgattgcagaagcatacccaaagctgccattctggaacgcgctggtatataccagcatcagaagtgtggaggtcttaaagctgggcccgccgtttgtcatcagataaggcaccgcaaaaatctgcagcatccctatggtactggttattaaaatataagtagtggttccatgcagcagttttaaagtaatacgaaaaaatatctgattttctgaagccccgtcaatcctggcggcttcaaaataacagtctggaatgccattaatggctgccgtatacagaataaccggctgtcccagcccataggtgcatatcaaaagggccagcagcggaatcgctgttttgggactgtcaaaccaggataccggagtgaggccgcatatacggaataagcttgcaaccagtccgaaggtaggagaaaacaggaagttccacacaatgaccagcgccacctgattcgtgaccgacggaagataaaataccgctttggcaaaagcattcatctttttcccacgagtgctcaaaaccttggatatccaaagagaaacgacgacggtaaccggcaatataataactgcataaccaaaagtggcggatacactgcgccaaaaggcctcgcttccaaaagcctgcctgtaattatcccagccgcagaaaaccgacctgcttatggtatagtcataaaaggataccttaaaaccatacaaaaacggatatacagtaaacacaaggaaaaagcaaaaccagggcaaaaggaataaatatccccatttttctttatgtaattgtttcattcgggactcctttccaagtcagctcctgtgcaggagcccttcccacaggtgcaaaagggggaagcaccctggggcacttcccctcttgcctattgctgcagtgtttttgctattacttcatctcctgatgtcttccagtctcttatcatatcttccgcatctttatctccggtaaaataagactggagctgtacatagaatgtctctctgaaatcggaccaccagggttccagaacaccgatggaagaatccgcatatgccgccgtactggctgccgcacgttttgcctgttcattcagcacttcatctccgtaatccacatccagatcctttagtacggtggagtttcctgtctgaacacatacctcctggctgtatgcctcattttccagaaaagtctgaattaccttacgggccgcttctatttttgtttcatctccattattcttaaatacggtaaatcctgtgcttccccagctcataacatggggatccgcctttccgtccggtgttggaatttcataaatatccacatcaaagggctggatatcgccgctgtcaatctgtttttttacattgactgcttcccctgttcccgtactaacaaacatacaggccagtttctggctgtaccagttgggacggatgtcattatccacagtggttgctgcacctgcgggaaccaggtcctcctctatcaatgtacggaacagatcgagggtaaccgctgctttagcttcatccacagccatttccgtatgctcttcattgagaatgccgcttcccccgctcatcaggaaggagtaatatacagagtctgacgatttgcttcctgcaaaaagctgtgtggcatatatattctgttctttccctttttctcttgctgctctgcagaattccaggaactcctcatatgaccagtgaatcttatcctccggcagaagatcataaacgcccagttcctttgccatggacacatttaccgttatgttataaccctgagacagattaatgggaatatacccctgaataccattcagcttccctgtatccagcactccgtcatacagcaggggactgagttcctctgctgtgacagaaagatctgctgccagccctccgccgattgcaggcgcaattctggaatacgtatccagatacagatccggcgtggctccggtagccatggcaaccgtaaccttctcaggtcccgcatcccatgtcaggacctccgtattcaggatgattccatacttatcctttacttcctgagccagatccctgctcattttttcatcaaagccttcatataatggcatataccagaaagtaacttccgctccttccagatctgtctgctgtgtatccgccgcagtttcctgttcagcagcatcggaagcagcctggctttcctctcctgaggcagccgtcgtatcctttgtttccgccacctccgccttatttccgcatgccgtaagcatcacacctgcgagcattaacgcaagcagcttttttctattctttttcatagaaccccctctctgtccgtcccttcggacatcgatttcttccgtaaacagataccaatcttgcaagatagctatattataattttttaagcataacgataaaatcaggcctgtttggaaattctccggatttttatgttaaaattcctcacattttcctaatattccggattttccgcatattcccgcggtctttttcccgtaagctttttaaatacttcataaaaataagaaggattgctgtatccggcttccagcgctatctgataaattttcatattgctgtttctcagaagctctttggcctgttcaatcctgaccatattcagatattctacaaaggtaaaacctgtttcttccttaaaaaggctgcagaaataaacggcggaaaggccgatagcctcgctgacctgagacaaattcagttcttcttccttataatgttcccggatatatagcttcgccttttctattactcttttgccttttttctggctttgctgctgtttatatgcttttatctgcccgcatacatccagcagcactccctgcagctccagaggctccctgcactgaagcagtgaaaaataaggatcctccgtgaaacagccttccatatcccaacggatttcctgacatgaggtcagtatttccgacagcagcttgatacactccttttgaatacaggaaaaagaacccttagaagcgatcatcagacggttcatataatttcctatcgcctgtctgatatccagaaagcctgaagaatccgagtaacggagtacctctgccatctctttttccaagcggataggctcccgctcctccagaaccaaaacgttttctatcatagtcacatgattcctgccatatatattgctgtaatccaatgcctgtctggctccttcgcagctcacaggcaaatttttcatactgtccaccagactgcctatccctgcctgaaaatcataatgggaataggtctgaagcttgtcccgtaccctcatcatcattttttccgccgtttctttgtcaggactcttcatctgaataaaaacgaacccctgtgaaaaatctttccagagaacccggcataccagatggtattcgtttccgatttccgatatcatgttctgaagagcgaactggaatatctccttatccgcaattttcatacgtccgaaatcaggaaccaaagccactacctgaaaattaattcccactatttccagattcagcttgtccatatgcagcatcagttcttcctccgtctcctctgcaccttccagcacttccagcatatatctgtcctgaaggagcggaagattttcctgaaggatctcttccatacgctggaactttgccagctcctccgtcttcttcttgatattatccacagccttctgcagggcaccgataagctcacccgaatccagaggctttaaaaggaaatccacggtaccggctttaatagcctccctcgcatattccaaagtcccaaagccggtaatgagcacaatctgaatatccttttccctctctgcaaaccttcgggccaattccattccgtctattagcggtatattaatatctgtcaggacaatatgaggctcatattgcatgaaaagagccatcgcttcctcaccttccgaagcttcggctgccagctcaagttccatgctctcccatgggatgctttcctttatatgttcccggatcgccttatcatcatcaattatcatcagtctgtacatgttctgtcatctcctccggtatggtcaaaataacttttgtatattctccgaattcactttccaggcacatagtgcatcggggaccgtaatatagcttcagtctcctgtacacattccagagcccgtaactgtttccctggcatttttcttcccgtattgcttcctctatccgcatggttttatcctcctccattcccatgccgttatccataatctctatacagattccgtttccatcctcactttccacccgggccatgcttatccggatccatccgtcatttatatttcctgaaaacgcatgaagataagcattttccacgattggctgaagggtaatacgaggtaccctgacagaaagaaatttttccgcaatatccgttatcagttcaattttcttccctctgcataacatctgcagccgcatataatagcttatgtgatcaagttcggtacgtatggtatgaaaggcatcccctttccccaatgacagcttgaaaaatccgctcatggaacgcagtatctgcagggccatatccatattacttttttccatataaaaaatagccacatccagagtattgtacaaaagatgcgggttgatctgcgcctgaaggaacctgatctctccgaactggatttgtttctgctttttcttatcctccgcaatatagccccgaatatcatccagcattttattataggtttttcccaggtaatccacttcatccctgcttttcccctgatacctcagctccagattgcctgctcccgtacgttccataatatcctttaaatgcttgatattacgggttaatccccgggaaataaaataagcggccgccatggaaagcaaggtgcatattcctgctgccgcaagcatggtgaaaaagacagtatcctgtgtggttttcaggatcgtattttccggaaccgcagccagataccatcccttgtcccctaccggaacataaaaaagcgcaccggattcctcctctttcaaatcaacccttttaccgatttccgttctgtctctcgccgaaatcacaatgccgtcttcatcagtcaggaagctctcctcaccgaaaaaagaatacatatcctccagaaccttttctttcacatagaacaccagcattcctaccggttcattagaaccggtatcccgcaaaatacgcacattcataaaatagggttccctgacaccattctgcagatctattgccatggggatccataatgcatagctgctttcctcagaaaatccttttttatattcctctattacctccatacagctgtcatagtcataatgcccgaaattattttccaggcctgcggaaacagaaaatccatccttacggtacagagtaatctggctgatggatgaggcggcattcaaaattctcaggaaattgccatatacctgattatgcaaccccacaggatcctcaaccgcatgcttgctcagcaatatatttctcatatccttgtcaaaaaaaagtgaaatcgccgtatattccgctgcatccattttttccacaatattctttcccgcaatctccagatttgactcctgaagcagccggttcattcttactgcttccgatctgaatcttgtataaagaagtgcaatacctaaaaacatgatgatcagactggtaataaacaagcttcctgctattttccgcatcaggccggaccgttttttcaatatgcatacctcctttgtgtagaaacacccaatttcagcataacatatctgtttttccaagcctatcaggaatcttatcatttaatctggtaaattaaggtcacaggttatttctccctcgtattaagatactgcatgatcgacatatgaatattccaggccaccttctcctgataataattatcacaaagcttctcagcctccgcgctgttggacaggaaaccgcactccacgataacaatcggttttcccgtttttttcagcaggtaataactgtcgttagccttggcctgccggtgattctccggatccagatactgtatcatccggttttggatcatctccgccagctccttgctttttacacttccattgtaataaaaaacctgggcgccgttcacatactcctcgccatagctgttctggtggatgctgactgccagattaggctgtgcctcttctataatctgaatccggcgtttcatatcctgcacctttttattggaggcattttcgtcgtaaaggcctccgtcgctttcccgtgtcatgaccaccttcacgtccgacgcttccagaaacattttcagcttctccgcaatctgcatgttcacttctttttccagggccccgtttattccgatttttcccggatcgtctcctccatgccctgcatctatgaccacgcaaaactgttccgtcttctgcgccgttccttcgttgaccagcacagccgcctgccttgcggcaaaaaaaacggacgtacacagaataatcgtcactacgcccttaagaagctgttctttaagttcctgcctcataggaacctcccgacttttgcttattccattctatgtcctttccataaaaataagaacccatcgacggatcctttcctttacagcgcaaatatagatcaaaaaatgttttgcccgcagtcttcgcaggcaaaacattctttttttataacatattagtttggttcaagctcagccgttagcgaaaccggacaaaacatcccatacctcaggatgtcccttttcatatcccagcttccatgcagccacaccgcctatattatagcttttcatgatattcatcttaacttccaaagacctggcatcttcgatccaaacctgatagaaggaatcaccatcctgtacctcggcataattctgacaggtatcctcgtcccagaccgcctctatatttctgtcggaaaggaacttctgtacagcgctcatacctacggcctggctcttcacctcaccgccggacgtttcccaaatccgcgtgtagaagggtacggcattaatcactttctccggaggcacggactggaccatggtgctgattccttcctccacataaccgatggaagccacgctgcccggctcctgggaaccgccgtaatgctcatcatagcccatgataattacgtaatccgccactttcccctgttccttccagtcataatgagcattgtaattcttaggcacataattatccacggaaagcaccaggttattcgccctgcaggatatggacaactctcttaaaaactccacataatcttctcctgcttcactgctcacctgctccagatccacattaatcccgtcaactcccagggcaagcgcctcatttacaaggccctcaatcagcttagcccttttacttgtataggataaaatttcttttgtattcacatcataggtaaaattgtccagaagcgcccatacttcaagccctctgctgtgagccttgtttacataatccgtacttccgatgctcacaaaatttccatcatcatcgctcaggaaaaaccaggtcggggatattacattcataccggtaatgccgtccaacactgattccagtgtggagttagctgattcactggtaacctgatgccatcccagattgattttgtaatccctgcggatactggtatattccggctcctgatagtccgttaccgggataagcgtctcgctgtgctggttcttcagccgcttattctccacatatcccagaaaaccatcctcagtagccaccttgctccaattttccatttcttccaatataacgaccttatctccggctgtcatgtccgtgagaatatcgctttttacaccgccctgatagcggacagcggtatccttcccaatttccgccgcctgatgctcattccaaatggtagtgagcacaaccctgttcggctcctggtataatgtaaaggagaaattggtgaatttctttacatagtcaagcgccacatacattatgccgttatccagaaaagcgggaatgtatccttcttctccggaaacgcctgcctccgcccggataatggaatccggagtggtatataaaagcagcccttcgttataatcggcataaaaccggtcattaaggtactcatgcaccgtatccaaatccagatagcatctgccctctgacaattttcctttttcttctttaatttcattatttaatacgagggccacatcctcccccgtttccaaaccataatatgcattcaggtccatcctctctttggaataagagaaacgttccagaatcttcgtccctgcagtaatggcaataatcacgataataaggacgacagcgattattaccggaagcttttttttcattatccgtaacctcctgaccgtccttattataacagactatttaaacatcgtcattacctatttttacataaaccgacagaaattgactcttccatattccgcagcggcagtacgggggaccgcttttgtgcggataacggaattcgtgattttttagtattttgattatgaatcagataggaaacaattctattgtttggcaataagagttattaacggtattttaccttatcataccgtacttcccgtaatttgccgtccgtatcggtgacaaaatcgggcatgtagacggcatcttcgctgacaaaaaatttcctggcgatttcctccggggaagcaggcctgtcttcaagatataaatttacacctttcttgtgcatttcccttaagtgctcctccagcttaatctcgtcatcctctttgtgcatgtctaacatcctccgtaatttctatacgaaaaaacaccctcagcaaaaactgctgctctccaaaaggaacgtgatatataaatggacattcttccgtatgactgttacggcaatgacgacatttaaacagaaaaaaataagatgctccaggacatgtatcgcggaataagataaaaaaaacaaatacaacatgaattttgcgaattaaacggaacttagtgataattttggaaatgatttttaccacgacaagcacataagcctgtaagacatcctcatactatatagatgaggagaagatatagcgcatgcaggaaaaatccgatgcaactataatgtttgcttaaaatatgatataatagaatcataataaatgagatattacaacatctcattccggctgaaaaccgccctccttctgacactgattgtccagaagcatctctgaatgaaattatatccgaaaaatggaaaaatatcaagcaaaaatcttaaaaaagtttaaacagttactcaggacgcttgacttatttctttcttaagtataatatatttgataattgcagatactatacagatatgttcattttacaggcattttcagtcacacaagacaacaatttcaatatctttatattaaggatgtgagaacatgaaaattgaaaaagtaaatgatcatcagattcgttgtacacttacaaaagctgacctggcagatcgtgaattaaaaatcagcgagcttgcctatggtacggaaaaagcaaaaagccttttccgcgacatgatgcagcaggcatccctgaaatttggttttgaagcagaagatattccgcttatgatagaagctatccctctgaactccgattgcattgtactcatcatcactaaagtggaggatccggaagagctggatacccgcttttccaaattcgcgccaagcgttcaggatgatgagagtctggatgatatgatccaggatttgaatgaaggggctgacgatgtgctcgatttattcaagcgtattcatgaaggacgcgtcaacggctcacaaaacggacagaaggcttcttatcaggatgcgggaacagcagaagatgcgaccggcaaagaaaattctgccgacagcctggcatcagctgattcctcactcaatctggcaaagatttattcctttgattcattgaatcatttaacaaggctcgcccatattttgaacggcttctaccacggtgtaaattccctttataaggatggaagtaccggacgatatttccttatcgtcacaagttcctctcatacacccgaagaattcaataaactctgcaactgcctgtccgaatatggacgccaggaaaaatcagtacccgccggagcagcttattttgaagaacactacgaactgataatcagcgaacgcgctttacagaacttaagcaaaatttaatcatgcactgcaaaggaacaccgcgcttttataaagcgcggtgttctgcattaagcaatagctcttatttttgtgaaaatgacttttccggcgtaaatatttccccatcccggatttcaataattcttttacaacgttttgctatacttatatcatgtgtcacaatcacaatggttttcccctccctgtttaattccaaaaacaactccagtatcctgccggagttttctgtatcaagggcaccggtaggttcatctgccagaataacatccggattgttcacaattgccctcgcaatcgcaattctctgcttctgtccgccggacagttcatttacaggacagtctgccatctcctccatatccactttttccagggcttcaagagctttctcctctttcccctttatttttctcctggaaaaatccagaggcatcattacgttctccaaccccgtaaactcttccaccaatgcaaaatcctgcattacaataccaatacattcatttctgatccgggcagcttttctttccggcagtcccttgaccaacttctttttcaggaaatactctccttcatcataatcatccatacaggccatgatatgtatcaatgttgatttccctgcaccggactttccaataattgctgccatctctcctttggaaatctgcagatttacattcctgagcgctgtatatgcatttttttgattcctgttatataccttcttcaaatttcttatctgtatcatcctgtacctctattctctattccataaccgatatggcggcactttctttaccaataggctttgtactattactgtagccgcacatattagggaaattactatgcaaaatataaattgccaggctccaaatccgattgccatattatcagtgagcgaaaaaagctttaatatgcaaataatcaaaattgaggcaatgagtgaaatcccttctataatgatgtaggtaactgtttgtatccagacacatcggttccatgggaggccaagcatattataaacagccagatacttccattgttgtttagatacgatcacgccaacgcacagggaactaatcacggttagcagcaaaccacaggctaatacaggcacatatttttgaagctcaccggttatttctttccggctcttttggataaccacagataattcttctttttgagctataaaacagtgttcggacatatatttgatatttcttttcttttcctcgtctgtaattccttctttccatgttaacaacaccgttccctgcatcaataacagctcacttccattttccgtatttataatatcttcacggctcataagcaatacaggttcatcctgttttcctttggaaacggatgcgaacaaatttttataattgatcatattgtcagaaaaacttatatcataatattcggcatcgtccgccagaatccccactatttccacagaaacaggactatcctcagatgccgcaccatattcatggattgtaagtgtatcacccaaaccgatcccataactgttagacgctatcaccgcttccactgtattcgtgccgatatctgcatttttcagccatcttccctcttttatgtcaggcttataggcatcgataatcggctgatcataaacaatagtttttgcctgaattggcatttcctccttctgcaattctcctgaaagtgcgtaacaggccaatatatctgatgaggccaaataaccttcaagcatagcaggagcattaaccacatagttgtccggggttaatatatttcccccatatatataccatccttcttttttgagataattttcgaatgccttatattttgtatattcagtttccatcattgatataaaactgactgcgatcagaaatgtaataatgagctgcaaaagaataaacgtatataattcttttcttatttccagttccttaagcgccatttttataatcatttctttccttcccgcctcttataaataataccttaccggcttttttaaaatatgccctgccactgctgcactaagtacagtaaaggagacaatgcaataaacagcaaaaataaaaagataagtcttgcttgtatatactccatccaaataatgataaaccggatagagaaacggacgaataataatatgaaaaaacagcattcccaaacaaaatgccggcaatgacagcaaaatacattcccatacataaattcccactgccctgccgcggttcagtccacatactaaaaaaatccccatctgcctttttcgtttatccagtatatataagtaaagaattgtaaaattcagtgaaataacaagtgtgatcaaaacagctattgctgtcattatcacagcaattttcagttggatatcattcacactttccattggcggtattactgccagttctcccagttccttttccataatgcccgtaatctctttatactgctctccggtaaacatggtacggaacatgatagtaactccttcttttcccaagattgtcttcttatccagagatgcatacgggactaatacggaatccgtcaatattgtttgtgtgccaatgatgtggtactttttcccctgcagccaaataaatccattaccgccttctttaagcagcctgtccgttaccggtgtcttattttggcttccgcctttatcaaatataagaactactggttctcctttggcttcctgctcttcagaaaaataagtatccacccaacctgccctgagaaaattctcctttattttttcacctgatgcaaagaccccatcttttacggaaaaccgacattctgtgtataatttattttctatttccggtattactaaaaagcagtctaccttgttttttatattatcagaaaattgctctatacatcgatcaagcatttcttttgtaacatatcggttattttctttatcgtcctgaaaaccaataacgaggttcgttaacaggttgtttgaagccaatctttcatttgcataattttgatagataccaaaactgaagcttatcataatacctgatataaaaatgcagataaacattaagcagagaattcttttttcatttatcaataacattatgttcttaattgtgtatttaagcatgatattccctcattgctttatgtgaactttaattttctttaactaaatcatcaccttgcaacagtaccatttaaggcatctgaagagccagatatcccccaatgctctggcggcttctgagattgccagctccaagcatagcagtgaaatatcttcgaatacggaagataatgatattataaatctgttatctgtcttttaaataaactgcaataaactcaaaaacgtcctattctcttttgtttgttagtaaaaagaataaggcgttttaggttgactatctaacataataaagtagactaagactttatactacttgctttagatttttatcaatcattgatcctatatagaactaatttcattacgggtacaattccaatcatcaatccacccatttttattcttccttaatcggtatcttaggatcaaaaacttttgtaacagttgatacgtatactgaatcaacatataaatcatatgtattttccgcatttaaaacaaagtatgcattatctttattaaatgtattttcagcatattcttctgatatataataaggttcgcagataaaagaataagaaaatattgtcagcacaagtgcagaaagcaagaataacctattaataagagggaaattcctgtgccgggaattattcaagagaatattacctctttccaaaagcctcggtgaagaaataatcgaaaaaggtaccgtgcaaaaaagggattgctgattagtctgcttcattttagcaattttaagtatacattccaaatattcaattttttcgttttcagttaaattttcgtttacttttgcatccacataaaattccaatactttattaagtagcttttttatcataaaaataagaggattccaaaaatatataactgttatgaattcgcagaaaagctttatatgaagatgctttttatagtaatgacataattcatgttcaaatatgtaacacaattctttatgggttaaaaatacttgaggcaatgcaataataggttttcttattccaaataataacggtgttgagataatagatgaagaaactaaagtaaatgatactttcttattatatttgctgttaacttcgtttaaagcagcaatgatatcagaatcatttactgatctcatttttaatagcatataccgtgttttatgataatctaacattaactttatcaacaaaactatacttaccgctatccaactaatagaaagaaacttcagaacagaaacattaaaatttccaaaagttaactcaaaatgatataaaaattcgtataactgaggcataaccttcctaactggaatttcctttacaaagtaaaattcataaggaaaaaacaaccttatcgcaattagtaaaaaacataagattatggtgtaaaagcttaaacgtttaaaaaagaatctgtatttaagtgttataattataaaaacaaacattaaactggtacacagaatagtgtttactactgaagaaagagtaatctgcattttattctcccaacaattctttccttttagctttcagcaatgtttccaattcattaatttcatttaatactttatccggttcctgctcctgctcgagtaaagtagctacaaaacgagaagtagtaatatctttttgttcacttaacagccgttggatttcaaatgtttcaggactaatggtaggtacataagatcggctcaaaacagttccgctgtaaacaatctcattaacttttattaaaccattttttaataatttacgtaaacttgcctgaactgtatttaaagacataccgccgccttttttggcaatttcagatgcaaccaacgatttaggggatgtccataatacttccattatttccttttcacgtttagtaagattatatttatttgataaacctgccactttaatttctccttttagtatacatatatattatatgatattgtattctaattactgtgtcaatgtttgcatcaaataaatggtattacttttatcaacaagtacatacattttcatttctattaaatttattaattactattccatttatacgtgcttctatcctgtcgattcccaaataagtaaactcttcagggaaatcttacttgttaccgacaacagccagacaccttaatgcaccatcagaaggacctgttcctaatctctcctcgtccgtcctgtcaacgtatatccatcttttcttttttacatataaattcatcaatcgtttagtactaatcaagtattacatcatctgcatattccatccagataatacaaatccaggtttttcccggagttaatttgatattctctcctttttcatctacataaacagcaggatctgtatcgctaaaacgtgaccaagtaccttctatcattctccccttcgtaaatacctgtaccggatatccattatctccgtgactgccaaatgcaagataatcattctcatccctaacttcgccataacaatactgtaatattacattttcataactcagctgattgcctgtttcctcatcaatttgcggaccgccatattggtaacgatagtatttaccatttttatattcaaaatatgcctgaatttttccataaccattcctggcatttactgcttttcctccgggataaatcatctttacttctgtcttatccttataaatgtctttgtccttatcattgataaatgtgaatttaggcttaaaagtctcatgataagtcaaggaatagccaaatctatccacatccattaatatatccggtcctgatgtaataacattatgcggtgcctttctatccacggttctatgaaaggcatatttagccggatgattaatccctgcaacagcagcgctaatagtatccactttgccgctattgagcaattcacccacataaagagtcgcctgcccaaaatgacaataaatagcatcgtgttccattgcgctatacacaaagtaatctctgctgctgcgaatataacctatcttcttaatactctcccaattttcaaataatcccattaaacgtgtaatcctggtttctattggcgcttcatatataacagaagctttctcaattccatattgaggacatccactttctatattacttaacattacggctacaggcctaatatttcgtttttcttcggatattggcaaaccggtaagataactatatatattagtttcttccggaatatcctgtaactcttcatctttagccttttcaggttctgtaactgcaacactatctatgctttcaggtgtaatgtgatgaatttcatttccacatgccataaacatactaagaataaatagaaacgataaaacaatccagtattttctcttatgcatatttctccaccatcctatttattcagccaatataatctcgtttgaattaaaatcagcaaataaatggccttttcccatcctttattttctatgttcttattccaccatgctttgaaatcatcagccagttctacatagtcccttttaagaatttcatcattgatctccagaattgctttttattatgataaatacagttatccagctgtattctttcattatctctatattattcgtacattttaggtataacaatttcaagaaatatataattaggatgagctaatatggcttcgtagaaattatattaataaaataaattctataaataaattatcaggcttattaatataggaaatttctttataaattatattatttactaacagtgtattttatttacgctaaataatactatattttcatataaaatgcaatagaaatactttatatttaattgaattaattattctgtattttaaatacattattaatttttaagtatggcctcctggatctgtatagggctgctttcgcgtaaatacgcgataacagccctatgcagatcccaggaggccattaatacaaaaacctctgcatatgcagaggtttttggttagtacattttataatgcttcgattttactcatcaaatcattaatatccattccatgaaccatagcagcttcttccaggctctctccctgagcggaaggacatcccagacaatgcatgcctgcttccatcaaaatgggagctacatcgggattggttcttaaaatttcaccaattgtcatttctttcgtaattccagccattatgccatcctccttttcctctgaaactatcagcggcgcatgcctgccgatttctcttagtataatacttttccctgaaatacgcaagatatgcgtttttctttaaatataaaaattttcgaaataaagttatatactttactcttattgatcgatttttattaaaaaagcataaaaccgccctttgtttgagaaaaagaacagtccgcgccttgacgaagcactttaggaaacatataatacaggtgcgggtgacgcctgatataggttctatccgccgttttacccggcagacggctccgccgtgctgctgactgattatcttacagttcatgctgctttggcagcgaaaaggaggaaaatcttgagaacagaatggaatggttttattggcggtgattgggaacatgaaatcaacgtgcgtgatttcatccagaacaattaccacccttatgacggggatgaagcttttctcgcaggccctacccggaatactctggatctttgggatcaggtgctggatctgagccgcaaagaaagagaagccggcggtgtcctggatatggatacaaaggtcatttccaccattacgtcccatggtcccggatatcttgataaatccaaagaaactatcgtaggtgtgcagactgatgctccctttaaacgttctttacagccttatggtggaatccgtatggcgcagaaggcgtgtgccgataatggctataccctcgatcctgaggtggaggaattcttttccactcacagaaaaacgcataatgcaggtgtttttgatgcctataccccggaaatgcgtgcatgccggagcgcccatatcataacaggccttccggatgcttacgggcggggaagaatcatcggtgattacaggagaattgccctctacggaattgaccgtctcattgaggacaagcttgcacagaaggattccaccggcagtgtaatgactgatgatgtcatccgtctcagggaagaaatttccgaacagattgtcgccctgaaaatgatgaagcagatggctgcttcctatggctgtgatatttccaggccggccgcaaatgttcaggaggccatccaggccacttatttcggttatctttccgcagtaaaggaacagaacggcgccgccatgtcacttggccgcacctcaaccttccttgatgtctatgcagaacgtgatcttgcactgggaacctttacggaagaacagattcaggaattcgtggatcacttcatcatgaagctgagaattataaaatttgcccgtactccggaatataacgatctcttttccggcgatcctgtctggattaccgaatccctggcaggtgttggcgtggacggacgccacatggcgacaaaaatgtccttccgctatctgaataccttaaccaacctggggccttctcccgaacccaacctgacggttctgtggtccaccagacttccgcttaacttcaagcgctactgcgcgaagatgtccatccagacctcttccatccagtatgaaaacgatgatctgatgcgtgtgacccacggtgatgattacggcattgcctgctgtgtatcctctatgagaatcgggaaggaaatgcagttcttcggagcccgggcgaacctggcaaaatgtcttctttatgccttaaacggcggtattgacgagaagagcagaaagcaaatcgggccgaaataccggaagtatgaaggggacgttctggaatatgacaaggttatggacgcctttcacgatatgatggaatggctggccggcgtttatgtaaataccctgaatgtcatccattacatgcatgataaatactgctatgagagagcgcagatgtcccttcatgacagagatgtgcgccggtatttcgctaccggtatcgcgggtctttccgtagtggcggattcactttccgccatcaaatacgcaaaggtggaacccatccgtgatgagtccggcattatcgtggatttcaaaaccaccggtgatttccccaaatacggaaatgatgacgacagagtggataccattgcaagagaactggtttccagtttcatgaccatggtcagaagacatcatacctacagggatggtttccccaccacatccgtactgaccatcacttccaatgtggtatatggaaaagccaccggagccacaccggacggacgtaaggccggagaacccttcgctcccggagccaatcccatgcacggaagggacagccacggagccgtagcttctatggcatccgtagccaagctgccgtttaaggatgcgcaggatggtatttccaatacctttaccatcatccccggagcccttggaaaagaggatgaggtttttgcaggcgatattgaaatcgacctgaatctgaacgaataaaaaaggagctgttttatggatcagaaggctatgatagatgatttggtccggatgctggactctggtgcagcaaaaggcgtaggccatatcaacgtctcttatgacgaagccctgccggacagcaaagaaatacagaccctggggtgcccggactgctcagccgcaccgctggcgtgcagcgttcccaccctccatgagggccttgacgagaccgaagacgaataacccactcaataaaagaaaggaatacaaactatggaagcaaacagcgcacagatagataaccttgtttctttacttgacggctatgcagaaaaaggcggccatcatctcaatgtaaatgtattaaaccgcgagactcttctggatgcccagaagcatccggaaaaatatcctcagctgaccgtccgtgtatccggctatgccgttaacttcatcaagcttacaccggaacagcaggcggatgttatttcccgtacgttccacgaagctctgtaaacgcataaatccatgattgcattttaagcagttataagggggactggcgcatatgcggcagtcccttttcagcctgcttccatcgattgtgaaaatccgtttttcatggtatactttatttctaaagcacgggcttgtccataaggcaacggaattcttacagaaaggcatgcccgattaacagcagtttgtgatggagggtttgatatgcaggccaatcgcagtaaatcatccggttccggaaccgcgcttttgtcccttaccagggagcagatcctctccttccggcttaaaagccataacttaacaggaatatctccgtctgatatccccgatgcctttggagggtggattatgcagaactcacctcccggggcctgggaattatctgtcttttcacgtatgcccgatattaccctttccgcattagatgaagcgcttaccgaatcccggacacttattcaggcctggagcctgagaggcgccccctgtatctttccggtacaggactgtgacgtatttctcacagcactgatccctgaaaacgagccctggatctatacaaggggcattgcactcgtccttgaacatttacatatgtcaatggatgaactgctccctcttgtaaaaaataccgccctgattctggatgaaaatgaaatagccggaaagccttctctggatcatatcctggccgaagaagctgccaagtctcttgacagcgtaaaaagagaactctggtattccccgtcctttttttcacccgaacagactatgggagaagccgctgtttcctttcttcttcgcccctgctctttagaaaagcttgttgtattcggcaaacgggaaaagaacctgcccacctttacttctctgcggagctggagtccatctgtcttcgatccggaccgccgcgtaccgtctcccactgccgtgctggtgaaacgctttctgcacagctatgggcctgcttctccggcaatgcttgccgacacactgggctgttcccccgcccaggccaaacgcatgtggaaggacgcggaacgaatctatccgattatccctgtccggtcaggcaataaaacggcttttattctggaagaagacctgccttctttcatggcgccggattcctctcttaccgactgcgatatgtctgttgccatcctttcgccccacgatccgtatctggacatccatgaccgtgagctcctgcttcctgataagcagcttcagaaacaggtttggaaaacagtagggaatccgggtgtaatccttcggggaggtatgatcgacggaacctggcgttcgacaagaaaaaacggttcgctgtcagccgagttttctctttggttcactccatccgctgcacataaggaaataatggaacgatggtttgaaggctatgccaaattgtacgatttaaagcaaaaagaattaaaaataaatattatgtaaataactaacatcatctgcttaccagagggcaaatttctaaagaaattgcattttgttccgcaaaacatggaggattattatgcagacaaatataccaaccaatacgcagggacgcatacattccatcgaaagcttcggtactgttgacgggccgggtgtgcggtttgtcattttcctgcagggctgtcccatgcgctgcgcctactgccataatcccgatacctgggaaccgaatgcaggaaccccggcttccccggccaaaattatggaacgctacgaacgcaacaaaagcttttataaagacggcggcatcaccgtaaccggcggggagcctctgcttcagctggattttcttattgaattatttacccttgccaaaaaagaaaagattcatacctgtatcgatacctccggcatcccattcgcgccctccgacaaggaatggatggataagttgaaaacgctgatgtctatgacagatcttgtcatgctggatatcaagcatatcgatcccaaagcacataaaaacctcacgggctgctccaacgacaacattctgcgttttgcccggtatctggacagggaaaaaataccggtctggatacgccatgttgttgttcccacggttaccgatgatgaagccagcctttaccggttaggctggtttatcggaggcctgggcaatctgaaggcgcttgatgtgcttccctatcataccatgggcaaagtaaaatatgaaaagctgggcattccctatcgcctggaaggcattcctcccatggacaggcccactcttcttctgaaaaagcaggccattttaaaagggatccgggaccgccggaaccagcggcagcccgccttgtaaaatctgtatatttgttctttaaaaagtacaaaaaatcgccgtatattcacaaaaaatgtcttgtacaaaatcattttctatattagaataggtaatgataatcaatagagaataaaggaggatatcattatggcatatgtaattaacgattcttgtgtaagctgcggaacctgcgaaggacagtgtcctgttggcgctatctctgcaggagattctcagtatgtaatcgatgctgatacctgtatctcctgtggttcttgcgcaggcgtttgccctacaggtgcaatctctgaggaataatcccggaaaacacacataagaagcattcaagaaagaagcattcaaaaaaatgaatgcttctttcttttttctccgttagcagccgccttgctctcctcctgttttttctgttcctttttttctcttccggtaagtctcttcctgctgcgctgccggagcagctcgtccagttttctgtaatgctcttcttctctgtcgattctcagctgttccctgcgttcattttcttcttcctgcacacggaactggtagtccatttccttcatgatggtttctttgatttctctcgtgagatcttcattattttcccttaccgcctgggaaatcagactgtgcagaagcagctgaagccgtgctcccttatcctgtatatcccggcctccggtttctgacagctcctcctgtacgttgcgggcggcctggctgtgttccctgaggggaaccattacctgcatgctgctgtccgtgagtaccgtacggatcgccttcagctgaagcccctgctccttcagctttttaatttccttaaactgctccacgtcctctttggtataataacggtgccctaaatcatttctgcgtataggcagcttcagctcttcttcccaataccggagcacgtggctttccactcccaccagctttgcggtttctgaaatcaggaacatatccttttccggttcctgcttttttccttcctctattctattttttgccggcatttcttcttcgttcctgcctgtcctctcctcttttaacaaaaccaccttactgctttcttttttatttcccatgctttcctcctgtctgccgtctgacggcacttcctttttatataagcaacgatgaactggtttatctggttatctatataaaaaaagagaactccggcataaccgtatgttctcttttgtaagtgtattcctattttgttgtgcaaagctatttctgcagatttgcgaacttggtaaattcgggaagccataccaggtcaatggttccgataggaccgtttctctgtttggctatgttgatttccgcaattcctttcttctccgtatcgggattgtaataatcatcacggtatatgaacataaccacgtcggcatcctgctcgatggctccggattcacgcaggtcagaaagcatgggcctgtgatccggcctctgctccaccgcacggctcagctgggataatgccagcacgggaacctgcagttccctggccaatgccttcagcgaacgggaaatatctgaaatttcctgctgcctggaatccgttcccctgccgcttcctgacatcagctgcaggtagtcaatgataatcatcttcaaatccatttccagcttgaatttacggcatttggaacgcatatccgcgatgctgatacccggggtatcatcaataataagcttggactgtccgatcatgccggcgctctctatcagcttttcccattccatgtcggaaaggttgccggtacgcagatgctgggaatccaccttggactccatggcgaagagacggttgaccagctgttccttgctcatttccagactgaatatggcgacgcactcaccggagtgaaaagccacatactgggcaatattcaaaacaaacgctgtcttacccatggaaggcctggcagctataagtacaagatccgacggctgcattcccgccgtacggtaatccaaatcaatgaagcctgtggcaataccggttacgcccccgctgttgtgggaagccttttcgattttgtccatggcgttcataaccacttcacggatagggacgtaatctccggtatttctcctctgaacaaggttaaatacctttttctccgtctcctccatgataacttccatgctgtccttgccggcatagcagttgttggcaatctcctccatcagccggatcagacggcgcagcatggctttttccgccacaatgttggtgtaatatttaatattggcagaggtaggcaccgccgtgatcagatccctgataaattccagactgctgatttccggaggcacatccttttctttaagcctgttctgtaaggtaaccagatccacaggctgtccctggtcattcaattccaccatggagtcaaaaagcacgccgtaggacttattataaaaatcttctccgcatatcaattccgatgcgacaacaatcgcttctctgtccattatcatggaaccgataacggattgctccgcttccaaactatggggcaatactctttttaaaatagcctcatccatcgatgccattgataattccttctttattcttctactttaaccttcagtataccagttaccttctgatgcagcttcacgggtacatcataggtcccgaacgctttgatcgcatcagtcagctgaatctttttcttgtcaatgtccagtccgcactgatccttgaatgcagtggctatttccttggaggaaacggagccaaacacccttccgccttctccggccttcatcttaatcacgacggatttgctctccagatcttttgcaaaagcctgagccgcttccagtatttcttttgccttcttttcttcgttggcattctgcagcttcaggtcattcagattctttgtattggcttccaggcccagctttttaggcagtataaagtttctggcataaccgtcattcacatttacaatttcaccctttttccccagggcttttacatcttccagtaatataaccttcattatctcagttcaccttcctctatcattttatccaatgtgccttttattgtaccaataacaatcccaagctccgaattatcaatctggcagccggctacgttcatatgcccgccgccgcccatccgctccatgattacctgtacattgacctcatcaatggaacgggcgctgatatatatccggccctggtattccgtcagcacaaagcttgccttgatccccctgatattaagaagttcgttggcagcctgcgcccccacaattgtaggactctgaatcccgtcgcttcggcatacggaaatggcataatcattgcgatagatttccgcctgtcccactgcatccgccttggccttatattcggccgcattttcacggaacagctttctcaccctcgtcacatccgcgccgttccttctcaggaaagcagcggcctcaaaggtacgcacgccggttttcgtcataaaattattggtatctatcatgatgccggaatacatgcagtcagcttcttcgcctttaatgcgtacgccgtcattgatatactgtaatatttccgaaaccatttcacaggtggaggaagcataggcctccacataggaaagggtggcattttcaatcgtctccgttccctgcctgtgatgatccagcaccacaatggacttgcaaaccttaagcagctccgggcattcggtaatgctgggtttatttacatccaccaccaccagcacagtattgctgcctgccgtctccagagcctgctggctctttaaaaacatgtcctgctcatactcctggctgttctggaacatttcaatcagtggctgtacggaagtcgtaatttcattaatgacaatctgggccctgcgatccagcgtcctggctatgcggtaaataccgattgccgcgccaaagctgtccacatccccgatctggtgccccataatcagaaccctgtccttgctggtaatgatctccctgagggcatgggccttaacacgggccttaacacgggtgttcttctccacctgctggctctttccgccataatagctgatctgctccggcgtcttgaccacacactggtcgccgccgcggcccagggccaggtcgatggccgttctggaaaattcgtaattctgggaatagctcagcccgtccaggccgatgccgatacttatggtcaccgccatctcattgcctatgtttacggtcttcacgtcctccagaagttcaaaacgcttctcactcatctgggctaccgctttcttacgcagcaccgtcagatacttatccttttcaatttttttgcagattccgtcgaagccggaaacatacttattcactttcctgtcaatcagcgccatcagcagtgatcttcttacctcttccacgctttccagcgcttcatcataattatccaggtaaatcattcccacagccagagactgatcatcattttcccgcagagcgatcttcaatgccgtctcatcaaacagatacatggcatacagacatcccctgtaatcttcctctcctattatatcgctgtcatccgccatttcccgaagggagatcctggtaaatctggcgatatactcgctttcctcgtaagaaatctcaaattctgcaatgccttcttcttccgtgggaagcctgtcctttgtggcggaagaaaaaaaggacgtaacggatttgtgcagggctttctcattatgtatcgccctggcaaatgcattattgttccatacgatctttccgtcctcatccagtaaagcataagggatggaaagctcccgaagcagttccttctgtatctgtccgtactgcgtggcaaagcttaccagttcattaattataataggcctgttatacagcatcagatacagaatcatcgcaaaatagaatacaagaaaacaggtaataagaaaacccgcccgtatatccagaaaataaataccaatatccactaacaaaagcaaaaggccaagatacatggaaatctgcatatatatcttcagccttccttttagtttgactcttttcttcatctctatcctcatccgtagtccgagccggcccacaccttgccggcgggccatccatcgcctgaaaatcttttgattacgataccccggaaccaggtccggaaatacatatctttgatattataccatttttttttccagattaccacacttttcataggtttgacggacgacggtagacatgccttttttccaatacctgacaaaaaaggaccagccatcccacaggacagccggtccgacttttaaatttaccgctcagtacgcatccgtacaatttccactgcttagtctgctacgtaaggcattaatgccaaatgtcttgcacgcttgatagcaacggtgagtgctctctgatgctttgcacagtttccggtgattcttctgggaaggattttccctctttcggaaacgtatcttttcaatttatttacatccttataatcgatggtattatcttttccgcagaatacgcaaactttttttcttctgcgcataccgcctcttctcttcatcggagaatcagatctctctgctctattaaaagccatagtattgcctcctatctgaaaatcacattaattaaacggcagttcctcgtcaattccatccggaatattcatgaaaccatcgccgggtgcactgggttcaggcctggataccggtgcggaataacccccgtcgttactggccgcagcgttcttgctttcggcaaactcctgatcttccacaacaacatcggtggtgtaaaccttaacaccgtctttgttcgtgtagctgccagtctgaatacgtcctgttacaacgaccttcgtccctttgcgcagatatctctctgcgaattcagcgcttcttccgaatgcaacgcatccgataaaatctgcggagttctcgtcgttattgcggttgaaccgtctgtccaccgccagtgtatatctggcaattgccgttgcgctctctccctgggaatatctcacttcaggatccctggttaaacgtcccataagaattactttattcatattacctcctgtactgcgaatgcatcctcagtacaaattcaggaaagcacaccgcatccacaaaatttactgattatgcttcttcgcgcttaacaactaaatatctcataacgttgtccataatgcgaatacggctttcgatctctgcaggtgcagaagtcggtgcgtcgaactgaacgatgtaatagaagccttctttcattttctggatttcgtaagccagtcttctcttaccccattcatcaacgtttgtaattgtgccgccgaatctttcgatcagagccttgcatttgtctacaactgccgctctttcgtcatcttcgattttcgcattcacaacaaatgttaattcatatttgctcatgctttgttacctccttttggtctctggcccccttttcgggagcaaggaaatttatatatcacggagtaatatgatatcatagaaaaccggttaattcaagccttttcccgtatttcccgcacgtttttttccacaagcttcctggggaccatgatttgatggccgcagcccatgcatttcaaacgaaaatccgccccaatccgcagaacctcccattccctgctgccgcagggatgctgttttttcagtttcactatatttccaacctggatatccatttccgccgctcctgttctttacgtaacagttcagacaggtctgcactgttgcttctttacagccctgaaaaaatttccccaatactgccctgcaccaccagatccgcttcccggtcccttggcgtgggagtcttgttcaccaataccagcttatttcccctgtaataatcgatcagccccgccgccggatatactgccagggaggtccctccgataatcagcacatcggctttgctgatatactcaactgcccgtgtgaccgtctcattatccagaccttcttcatagagaaccacatccggcttgacggatcctccgcagctgcatttgggcactccctgtgaattcaggatatattcggcatcatagaacttatggcagcattcgcagtaattgcgcaggacacttccgtgaagctccagcacattcctgcttcccgccttctgatgcagcccgtcaatattctgggtcacgattgccttcagcttcccctcttcctcccactgtgcaagcttcctgtgggcggcattgggctgcgcatcaaggcaaagcatcttgtcccggtaaaaacggaaaaattcctccggcatcctccggtaaaaggtatggctcaggatggtttccggcggatagtcatatttctggttatacagtccgtccacactcctgaaatcaggtatcccgctctccgtagacactccggcccctccgaaaaagacaatattgtccgttttttctattatatctttcagcctttccaagctttcttccatatccggttcccccttatttgtgcaggccgccgggcctggctttggcggcagccctcaagaaggacggcagcaccgtcctctgtcacggtgctgccgtctcatggttattggcaaattccacatacttcatatcttcctgagtaatatgcaccttccaccattcctgcaggtactcaaatacttctcccagcatttcatcctgtgtatccagggaaagctgcggtacccggtcgatgaattcctgtaatttcctgcggaaagcttcatgacatcttatatgttcttccagctgatcaaatcccagctcccgcatataatcctcttcatatgcaaaatgctctgccgtatggaagctgagcccttccagaatcttattaatatcggcacatttaaacagcatattttcatccgtaaaaagcagataagctctttgggtatgatccagcattcttgcatgctgctgatcaatggtttcgtttcctgtacggtattcttcgctgacttcatattgcttcattcctaagtatccccacttccttttctctgtatttgtagtgaattctgccgtatcgccgcatgttccccctcaaaaagcccaacggcattttactatctgaggatagtataacataactttttttgtttgaataccgtaatattgcaaacgaaaaaagttaattttttatcaaagtctctgcatacatttccgcttccggcgcatataataattccatacgcttcccttccagccttccttttcattctgctgcgggaaatacggaaacagaaaggttacagtccatgaaaaaaatagcaatcgccggaatttccggcaatacagaaaattaccgcaatgccctctcacagctgggggccgtctgtaccacactcaccgacgccagccgcgcatcacagtttgacgcccttcttttacccggcggcggagatattgatccggtccttttcggagaaaccgatcatggctcccggagcattgaccccgcacttgacagacagcagctctccatgctcgatgcctttgtaagcgcaggcaaaccgatcctcggcatctgcaaaggaatgcaggttatcaacatctatttcggaggacggatcatccaggatcttcccacaaatatcctgcaccaatatacggaccgggatcaggtccatccaagccatgcgcttcccggaaccgtactccaaaagctttatggcagtgatttccccgtaaacagcgcccatcaccagggcatcggctcccccggccgggatctttccattatccaatatgctcccgatgacgtgccggaagccattatacataagactctccccatcctgggcgtccaatggcatcccgaacggatgtgctttgaacacagacggacggatactcccgacggaagccttctgctcgctcacttcctgtcccttattccctgagaccgtgctcccggcgggcatacagcaaaaaagacagagacgcttccgcccctgtctgcttttcctttccccttttactgctgtataataacctcttcccaatccttaatgccgatatagttcttcgcaaattcggtataggcatctttttcatccgtatctatgtatttaaaggtatcatatatgtatttgcggcgcccgttctgataggaaagccccagcgccagcccctgcgccacctctccggcatcgtccgtttccctggacaggagcatggaatcaatgtgctggttattttccgcgatataataggcataggcgaaggccgccgcctgcacatcctccccataggtggacgtaaatcccatctcgcttaaaatgacggaccggacttctccgtccggcatcaggtattcctccttctgcaggtaattcgttaccacatcaatattatatatggttaccatggaggtatcctccgattcctgtaccatctccccggcttctcccgtaagctcccagaacttcggccaggtcatgggataggaataaggatgatgcgccagtccccattggatatttccttcctcttttatacactcattaaaggcatccatcaaatccctggaatcataactggaatcggagcttaagttcctgttccactgctggtccagggatatgtaaatcctggcattggcgttaaagctcttaatcccgttataaaacagcctgaccgccctggcatattccctggcgtaggtatcgatatccacatacttcatataattccaggtagaccgcacattcacttcatttccgataatccagttcatgacaatgccgtgttcctcatccctgtatctttccgccagaaatgcggccactgcctccagataatccgttccggcctcctccgcggcattaaatgcataataataggcatttcctccccgtgacagcggatggataacctgaggataagcatctgatttgttattcagcaaaatcgccgttatcacaattcccttatccgacaaagttttaaaaacataatcatactcggaaaccacatggccgttcagcgtataatcctttccattataattataaataatggtggaataatcactgtgggtactgggcccgagaagcctcgctatggggatgttataagccgcctgcttgacccccagatcatccagctccgacgtccccagcttctgcggatccaccagcagccccttgatggaccccgctttcggataaggctccgaataatccgccagagcctccggattcgttatatactgaggcgaactcagcgcctcatactttccgtccttcttcaccgccaccacaaatttggagtacagccggctgtccgacgtattatccaggatatccgccttcagcataaaagacgccttcttttcggcacgcgcaatcggaaccgcgtcctccggcaccgcatcttcataagtcttcatggctaacagatacagattattatcatcactttccggaaaagcatccgcctcacccttaagcgcgaactgcgttccgtcaggaagcacctcacaggaaaggattgtaaccttcttttcccccgttccctttaccgactgcgttttctccgactgctccgcttccgccgaaccgctttcctgctccggctgaacctcttctaacccctcaaaaatccccgcaacctgtttcccgatattctcactttgatatacaataaacatagcagtcccaatgacacccaaaataagcaacagtaccgcaagataaattcccaacaccttgtttcctattgccttcttctgtttattagaccgatccccctttttccggggatcggcgcctttattttgttcctgcttcatatttattcttaattcctgttcctgaaaatggttgccttgttctgcttatataaaaactctgtcttttattgtaacataagccttgtccttgtaaaagtatgaataatgtctattttttattccaattcatataaaaaatatccaataaataccttacaccaacaatccatcccttactttttctccagataagcccgataactggtaggcgacatcccatattccttcctgaaattacgaagaaaagaagaataatccgaaaatccgcactttccccagacctcccctattgtcatcccctccttcagtccctcacaggaatacatcagcctcttattattcagataactatgcaccgtcatccccgtaagctccttaaaacgcctcagaaaataatacttgctcatatgcacacatcctgccagatcctccaccagaatcgtttccgacatatgagcctcaatatactcattcaccctctgcaccagctcatgatggatactctcctccttcgtaaaataaaaagaatcccgggaacacagctcattcagatacacaaaaaacaaaatcagctgcgccttatcaaacagccgcttcccctccgccccttccagatccggaatctctgtcatagccgtcttcaccagcagattcttaagaatctcctcataatgcaccggaaaatgatatgcacaatccctcctcccggaaaaacacccgcaaagatcctgctccccctccgaaagcccctccagcatcccctcactgatccaaagcacaatcctccgcgaattctcatgcttcccctccacataatgataattatgcatcacattccttccaattaacagaaaatccccccgttttaaattgtaagtcctgttatccaccagactagaaaactccccctccatcacataaataacctcataaaaatcatgataatgaagcctcaccgcccccgtaggcgccccacgcttctcataaatctcataatcctccccaatcatatactgccgctcatcctcaccgctcatataccgcgtccgtatcgtccccatactccccctccgttctccgttctccgttctccgttctccgttctccgttctccgttacaaaaagtctatagcaatttatgcatgatttcaagcaacaaataaagttttcaagcatttttaaatcccctataataaaactaacctacgattcacttatccaacccctaccctccggagccctgagagctgttcctgtatgggggccgttcccgcccggcggtccttcctgtggcggttctctccgcggcggatttctccgtggtggatttatccgcctgtatagcgggcgccgggggaaagtggttgataagtgaatcacgcaaaaatggagatatttcttactgccccgcttttctttgctgcggttcgcccaaatggcgctgtctgacgaacgaagtgaggagtttcagccatttaaccgcagcaaagaaaaacgggacagttagaaataccccatttttatgtctgaacatatcaaccaccttcccccggcgcccgctatacaggcggataaatccaccacggagaaatccgccgcggagagaaccgccacaggaaggaccgccgggcgggaacggcccccatacaggaacagctctcagggttccggccactccccacccaccataaaagaaagcgaggttccccccatgcaaatgacattaagatggtacggaagcagattcgataccgtaaccttgaaacaaatccgccagatccccggcgtaaccggcgtgatctccaccctttacgactccgttcccggagaagcctggccccttgaggacattctctccctcaaaaaagaaattgaggacgcgggcctgcagctcgcgggcattgaaagcgtaaacatccacgacgccatcaaaacaggctctcctgaaagggacgcctacatagacaattacatcaccaccctggagaacctgggaaaagcggatatccatatggtctgctacaactttatgcccgttttcgactggaccaggaccgagcttgccagagtgcgcccggacggctccaccgttcttgcctatactcaggaagcggtggacaaactgaatcctgaaaatatgtttgactccattgccggagataccaacggcacaatcatgcccggctgggaaccggagcgcatggagaaaatcaaagacttattcgacatgtatgaggatatcgatgaagaaaagctgtttgccaacctgaaatattttctggaacgtatcatgccggtctgcgacaaatacgatatcaatatggccatccatcccgacgatcccgcgtggagtgttttcggcctgccccgcatcatcatcaacaaggaaaatatcctgcgcatgatgaaaatggtggataatccacacaacggcgttaccttctgttccggctcctacggcacgaacctgcagaacgacctgcccgacatgatccgctccctcaaaggccggattcattttgcccatgtgcggaacctgaagttcaatagccccacggattttgaagaatccgcccatctttcctccgacggcaccttcgatatgtatgaaatcatgctggctctctatgatatcggttttgaaggccccatccgccccgaccacggccggatgatttgggatgaggtggcgatgcccggctacggactctatgacagggctttgggcgctgcctacctgaacggcctctgggaagctattgtaaaatctcacagcggcagataatccgccgccctcttaagaacttttaagaaaacagaaaggacattcactatggaattaacacagaaaggcatttcccaaaaggataactggcaggccgcaggctatgacctgccgcagttcgatatccccgccgttacgcagaataccctggacgcaccggaatggattcatttcggcgcagggaatatcttccgcgcgttccaggccaacgtggcccagtgccttcttaataaagggattctccataccggcctcatcgccgcggaaggctacgattatgagattatagaaaaaatgtaccgtccccacgataatcttggcatcctcgtcaccttaaagtccgacggtagcatggaaaaaaccgtggtgggaagcattgtggagtccctgatcctggacagccaggatgaagcggaatacggacgcctgaaggaaattttctgcgccccttccctgaaaatggccagctttaccatcacggaaaagggctacagcctggtaaacggcaaaggagagctgcttcctgacatcgcctctgatttccaggcaggcccctccgctcccaaaagctatctcggaaaggtagtttcccttgtttatgaacgcttcgaaaaaggcacccttcccatcgcactggtgagcatggacaattgttcccataacggggataagctgtatgccgccgtcaatgcttttgccagggcctgggaagaaaacgggcttatttcccacggtttcctcgcctatatcaataataaaagcaaagtctcctttccctggaccatgattgacaaaatcactccccgtccggatcctgccgtgaaggcggcgctggaaaaggaccatattgacggcctggatccggttatcacctccaaaaacacctatgtggccccctttgtgaacgcggaggaatgccagtatctcatcatagaagacgcctttcccaacggaaagcttcctctggatcagtgcggcattatctatacctcacgtgaaacggtagacaaggtggaaaaaatgaaggtgtgcacctgcctgaatccccttcataccgctcttgccatctatggctgcctcctgggctatactctcattgccgatgagatgaagaatcctctgcttaagaaaatggtggagattataggctacagggaaggccttcctgtggtggtggatcccggcattctggaccccggacagttcattgacgaagtggtcaccaaacggattcccaatcccttcatgccggatactccccagcggatcgctacggatacctcacagaagctgcccatccgtttcggagaaaccattaaggcatataaagaatcctcccggctgtccctggaggaccttcatatcatccctcttgtttttgccggatggctgcgttatctgatggctgtggatgatcagggcacgccttttgagccttcctccgatcctctgctggaaacagcgcgctccttcgtgtcttcttaccgtctcggcagcataccggaggatctgtcaggactggatcccctccttgccgacaacaaaatctggggcgttgatttaatcgaaaccggccttgccgatttggtaaaggattatttccgtcagcttggcgccggtaccggagcagttgaaaacaccctgcagaaatacataggagaatagcccatgaaagctttcatgaaccaggactttctgctgtccagcgagacggcccgcactctttatcacacctatgcggaacaaatgcccatcttcgattaccataatcacctgtccgcacaggagatttacgaaaacaaaagcttcaccaatctcacccaggcctggctgtacggcgaccattacaaatggcgcgccatgcgcaccgccggtttcccggaagaactggtcaccggcccccgcggggagttatcccccggggaacgggaggaatccgactgccggcgcttccgtgcctgggcggaaaccatagaaagctccatcgggaatcccctataccactggacccacctggagctgcagcggtactttgacgtcaccacccctctttctgcggaaactcacgaagaaatctggaatacctgcaacgccaaactgtcctcccctgctttttccgtccggaacctgctgaaaaaacagaatgtccaaatactgtgcaccaccaatgacccctgtgaggatctgcattaccaccgtctgctcagggaagaaggcttttccgtacaagtactgcctaccttccgtcccgacaaggcctatctgataggaaaagaggattatcctcaatacctggactctctgggaaaggcctggggcaatcccatcagctgtctgtctgatttgaaagaagcactctgttcccgtctggatttcttcatccgggaaggcggctgcctgctttcggatcacagtctggagggctgcatttatgccccggcctccgatgaagaagcccaggatatctttgccagacgtatggaaggcagcgcgcttacactcgacgaacgccgccgtttccaggggaacgtcctcacgttcctcggaaaagaatacgctgcaagggatattgcgatgcagcttcatattggcgccctgcggaataattccagccgtatgctgaaggccgtcggaccggataccggcttcgacagcactgacgattttctttatgcgggtgagctttccgctcttcttaattccatggacagcaccggacagcttcccaaaacaattctctactgtctgaaccagagggattatgaaatgctggcagccatgtgcggcaacttccagtccgcccccttccgcggaaaaatacagttcggaaccgcctggtggttctgtgacaacaaacggggaatggaggcccagctggaggtgcttgcctccttaagcctgctgccggtaagcatcggcatgctcacggattccagaagcttcctctcctttccgagacacgaatattaccgaagaattctctgcaataaaatcggtcagtgggtggaggaaggcgaatatccctgctgcatggaatatctcggcaaagtagtacagaacatctgctataataatgcccttcagtacctgaaagggacggatgcataaacaaccgtccctctcccggaagcaggccgaacccggcctgcttcctcactcaattcaccagcctgctgtatatcccttctatctgcccttcctccaaaccacagcatgcaagatacggtcttatccctccatagctttccatgacatggtcatagcacagagcgatcgtctccggatgggaatacatcagagacatggcttccggcggcatttccacctcataatcatcaaaaaaatcctgtcttttcctgctcagattcacataagactgcccgtaattggtcatacaatcctgcttatccgctcccgccagcatcatcagcagcagagcaagcactcccgtccgatcctttcctcctgcgcagtggaacagaaggcagccttcctgtacatctgctataaatgtaaaaatttctttgattttctccttatcttccagaagctgcagatacatttcacctaaatcagccacagcgccctctccggcatagcggctcatatccccggcctctcctcttaaaaagggaacatttttccacaaaaccccggaaacctccgccagtacatccggctttctgcaaacctctccgttactgcgcagatccagtacggaagtaaccccataccgaagcaggaactgtacatcgctttcacttaactcactgatatcatccgcccgcaaaaatctgtgataagctgtctgtcccccctcttctacggggtaaccgcccagctccctcacattgcttgcgaataccagcggcagacgcacccagtttttttcataatctttttctatttccatctttatttcctaacctttgcagtaatatagttgctcagtatttcgatgacgaacatggacaggaaaatcacaaggataatcgtcgtaatagaactgtatttatattgataaattgccctgttcagcagcattcctataccgctgacccccaccatgccaaaggagatgctttccgcgatattgctctcaaaccggatagcgatccaggatataaaaccgggtatgctctccgggagaagccccttcaggacaatatcaatccaccttgtcccggaggcccgcatggcttcaatcgcgccgcctccctgttcctctatcgtagcaataaagcttttggtcagatacccgataacaggaaacatcagtccaaccatgccgcccgtatttccgaatccaatgcttgccgccaccatcagtacccagacgagcgccggcacagcccgtattacagctacgatgcctttaatcgccgctgccaggatcggcagcggagtgatattcgacgcagccagaaaagccagtatcacggaaatcatcgcgcccgccaaaagtgaaaccacggcaagcgccatacttatgccgatgccggcagctatatcaggcagaatggccggattgatcgccgccatcctgcgcaggaccggccccacattggacagccgttccacaaattttccggcatcaattcccaatcccatgaagctgccgataaatccggctgccagcacagcgattgccagaaccttttttaatccggctcctgccggttctattctgtattcttccatctttgctcccatccttctcctttttcctccattccgtcagcggatcatgcggcgtattttattggtcacaaattcggtaagcagcacaataacaatgactacaagaatgatggcgcaggcttcctgatatttaaacagcttcaggtttgtctgaatgagaacgccgatacccccagctcccaccatgcccagtatggcggatgccctgatattaatctcaaaggaaaacaaagtccagtttatccaggaagggagaaattccggaatcagcccgtggacaagcacctgtccataactcgcacctgccgtctgcaaagcttccagatgactcccggcaatctcgctgatgctttccgcatagctccgggaaaggaagcccagagtcgctataatcaatgccagaagtcccacaatttcacccactccgaacatataaaccagaatagaagcccaaaccagaaccgggacatttctcaaaaaagaaataatccctctgcaaagcaggcgcagcggcgtaatagggttcgttttttccgacatgagcagaccgaaaagaaaggacagggccgtggacaggtaagttgcaactacagcataaagcaccgtatcaactactgccggcacataagccctgatatttttaaaggaagccggtaggaatttaactgcaaagaatcttgcaaatgcaggaaaccctttcactgcatccgaaggtgatatttccaggtaggccatacagccgcagaacaccaccgccacgccaaggaaaaccagaaaggtccggttcacgcgttccctggaaaccggaaatgtctccgctctttttcccgccaattcagccattctgaatcaccaccttttttactgacacctgtctggacggctccgtttccttcagtttcatttcatgctcttttccctgatatatgaaggctgtcatctcttccgtcagttcgtccggagcgccgtcaaaaaccacctgcccatcccgtattcccacgatacggctggcataacggcgggcaaagtctacctgatgcagattgacaatgcaggtaagccctctttccgatgtgatatcatgcatctgttccataacgatctccgctgatttgggatccagggaagcaatgggttcatccgccagaagcagcttgggttcctgaatcaatgccctgcagattcctacgcgctgcatctgtccgccggaaagggcgtccgcccttttataagcctgatccttcaggccgaccttttccagcagggcaaaggccgccttcctttcctccctgctgtattttcccagcagacttttccacagcggcatatgtcccagacggccgtaaagcacgtttttaaccacatttacacgtcctatcagattataattctgaaataccatcccgatttgggagcggagcaaacgcagctttttcccactggccccgcttatttcctgcccgtcaaacaagatttttccgtctgtcgagtcgatcatccggttaatacagcgtatcagggtggatttccccgcccccgaagggccgattaccacaacgaaatccccttccttaaagtcgatgctcacatcccggagggcaaccgtttccttgtcataacgtttggttaaatgttcgatatgaagcagtaccttatccattttcttattctccttcaatatgcagcgcttccagagtatcataaaccaccttataatcctcttcgcttacatctacaaaacgtatggaagggtccccatgcacttctgcaaaataacccgcatccgaataattgaggaaaaattccttcagctttgctttcagactgtcgggaagatctccgcggacaacataagcgggattgggaatcgtatccgtccgttcgataaccttcagctttccatcctccagcgcgcctgcctgcaccatctgatcaatcacggaggccgctaccgcgcccgcatcataatcccccatggcaacacctgtcgcaacagaaggatgctgtccggcaaacgccacggtatcaaagaaatatccgctgttttccaacaaatccggatccagagaaagctcttttaccagcttggccttgggatacatataaccggaagaagacgcctgatccacaaaagcaaaggtttttcccttcagatcctccagcgtattgatttcctcattgtccgcctgtgtaatgaaggccgtataatattcagaggccatgggcgtgctcaccagcagctgggcgttggctctttcctttgcctgatagtagctcatggggctgaccagcatgacgtcaatgttgcagctcgccattccttcaatccccacggaatattccgtgccctccatctcctttaccttaattccgagagcctcttccatagccctgctgaattcttcatgcttctgccccacattcgggttattttcattcggcatctgaaccaccgtgatttcttccggccaatcttctgtctgcaggccagcccctccctgagccgtacttccatcctgtgccgcgctttcttcctgcgctgtatttacctcctgcgccgcatccggggcggaaccgctttctgcccgtactgtcggcccgcagccgggcaataccgccataatacctattatcattgtcagcgccgctgcacaaaccatataattttttcttctcatttccttttactccttccgctgcaccatcccaagcagccagctgttttccatgtgattccttcggtagaataacacggcttttttccgcaatccacatagatgaagttaaaaattcgtaaaaaataaggcactgtgtacaaattcagacagcctgtattaaattttacaaaatcctgatattttttaagtacagaatcctttatacttcagattgaaacgatgcttaatacaggagaaaagagaatggtggcaaaatataaatatatgaagcacagcaccaaccagctgacaaaaatactcactgcagcggaaggcctttttatcaaaaaaggaatagaagccgtaagcttcacggaaatagcttcctgctgcggcattacccgttccacgctgtaccgctattttgagaacaaagatgaaattttatgggaaatccatcacagaaaaatcggaggctacagcagccggcttatggaatactatgagcagacaaacaaaactacctactcacgtttccagtgctttttccatcttttaaagcacattctctgcaccgcgcctcatgatttactctttcagtccgccttcagccatacctatacccgggaaaccatggacatggaaaacgggatttataatcatatattcagccctgacgaattccgttccggagacatgttccgttttctcaaaggcggcctgtttcacgacggctccgtacgcccggacctggatccggatgaaatctgcgccgccgcaattcattccggtttcggggctgttaccgcactggcccaaagtccggaccgtattattgtctgttaccataccgatgccgccacactggcggacgtcaccttttccctttttctaaaagccataaaaagtgaaacgccaggaacggatgcataaacatccgtccctgacgtttccttttttatgtatattactgcagttttcttaattcttccaccagaagcttcatatccagcggtttcaccagatatcccgtcatacccgccgcctttgccaggacacgatcctcatcgaaggcattggctgtcatagccaaaatgggaactgtccgggcatccttttttccggaagcccggatcgccctggaagcgtccagtccgttcatgaccggcatacggatatccatcaatacggcaaagtaatagccctccggcttcttcagatactgttcaacggcttcctgcccgttctccgcactgtccacattcagtccatacatttccagcagtgacttcgcgatctcccgattcagctcattatcctccactaacagaacatgccttccatcgaaatccaccgcagaatcctgtttgattttttcactgcagatttccgtgaagccgcccagatgagaaaaggtattataaatcgtagttttaaacaaaggcttggaaataaagtaattggcgcctgcccggcatgcctcctcttcaatacagctccagtcgtaggcggaaataataatgatagtcgtatccgggccggtgattttacggatctggcgggtggtttccaccccgtccatatccggcataatccagtcaaccatcgcaatatcataaggctgtccgctgtccatcgccgcctttacttcccgtaccgcttttcttcctgaatccacccacagggaacagccgccgatttctcccaggatatcggaaacctgctctcccacgatctcatcatcatctacgatcaggaccttcagccctttcagaagctctttggattttctcctctgttcttcctcttcattatcgttgattacgcctacaggcagaagtacggtaaagacactcccttcctccttcctgctctgcacctcaatgcttcctcccatgagctgcaccagattatatacaatggaaagccccaggccgcttcccacattgttccgggccatttccgaagattcctgctcaaagggctggaacagccggttcataaaattctcagacataccgattcccgtatccgacaccatcagacgcagataggcaaaaccattcgtccttttttcttcccgtatctccacctccacacgtccgcctgccggtgtaaacttcaccgcattggagagaagattcatgattatctgcttcagacgcagttcatccccgatataataatgctctatgggctcctcatagtacagttcaaaatgcagcccctgattcaccgtctgaggataaataatagatataatttcatctataaattccacaaaatcaaatttttccctggcaatggacattttgcctgtttctattttggacatatccaatatatcattgataagggaaagcagataacgggaggaggcgtcaattttgctgaagcagtcctgtattctgacaggatcctcttttttcagctggccgatagtggacatgccgataatggcgttcatcggtgtccggatatcatggctcatacgggaaaggaaatccgattttgcctcattggccgcccttgccgccgtcagcgcatccctcatcagctgctcctgacgggctttttcggctctctgtgcatccagcagcttaaccagttcaatcgcaagaatatcctcacctaccggattgtccacataaatcagctgtacagaaatccagtgatactctctgtcaaccccctttgcctgaacctccatatacaattcccgttcccctttccggaaacgttcctgcatattttccctgctgtaaaaggaagcgaagtcttcctgataggagggataaacgtcaggaaggaaatccgctgccatttcatcaaaagcgcctttcctgttcctcagaaagcattcctgctcttcaataaagcagttataggtattctgggtcagattaatgctcattatcataggataggccgtacaggtggccgcccggagcgactggttttcaatcagccgctgcctttcctgaagcatctgaagccttttggtttctgtaatatcagcgaatatggcctgaattacatcaatcccgtccgcatttaccagcctttccataactacactgatccagacctgcgtaccgtctatccgcctgctctcccttacataatccacggttcctgagtaaggctcaagctgttcaatcagttccgttatcttctgccgatccttatcaagaacaagctgcagaggagaacttatatgcctgcggtactcctcctcagatgaaaagccgtagaattcccataccatacggttcaggctcacaatttcatgggacttatctgttgtaaactgcaaaataccacagggtatcgtatcataaagctgtgtgaggaattccgcctgccttctcacctcctgattcaccgcatccatttccatctgcttctgcttgcgttcggttatatcggatatgaagcagtagatcgcatcctgtccgtccggatactccgccttttcaccgatgtccgatacccataaaatactgccgtccttacacattacccggtattccagactgtaagactctccccgatccagcttttgttttatattatcccagacactctcataatcctcctccaggatataaccatgcccggaaccccctgtaagctgttcaaactcctcagggccgtcatagcccagcagagaacagagagaatcactgatccattttgatgaaaaattattatccgcgccgcatatcagcataccccccggaagcctggaaagcatcagctcaatctgacgatccctctgctccagaaccctgctcagtttctcaaatgcctcttttccggcctgtgctgggaacagctcatcttccataatatccgaataatccacggaattatggatatgctttgttttcagcccttcccctgtccgttcaaaaataaacgtgatcctctgatgggtcctgaaatacagaccggtttccttcttcggctggatccagctgtctccctcgcaaaagaaaatattctctcccagccttcgggtcacatatctttcctctgtcatatcacagggggccagatcgcccttcccttcccggaaacaggcggctgccgcagcctttccttccgccttctgcctttctccggcgcccatccatacgatatcctcggcaaaggtggaaatcaggaattccacatccgactcacaaaaataactccgcagaattctgtctgcaaaagattcgacctcctgaagctctgtatccatgcccatgccgctttcctacctccgtttactcactgtatccagtatagcaaaatccaactcttaagtcatcagatttttgcccggcaacgagaaatagacattctcccggctatcaggtataattaatatgattttgttaacaggcatttatttgcagaagaaaaaactgggggatatgctatgaggaacattctgaaggtcgtgttcggacgtgttttatttaccgttctgtgtctgattatacagctgatctggatcattgcgcttgtctggaagctgaatcaatattatgtatggtttgccaccgtcatagaaattatcggtatcatcgtggttctgcggatcaatgccaagagcgataattccgccgccaggcttgtatggactatcgttatcctctccctccccctcttcgggattaccctgtatctgatgttcggaagaaccggccttacgaaaaggacaaaagcacattatgaaaaagtagcggggaaattcagccctgagcttaagcagaaaaaggaaatcctccaaagcctcaggggagaaaatatttacatccataaccagcagtcctatattcagcattccagcggatttcctgtatatcaaaatacggacataatctattatccgcagacagagcctgccctggaagccatgctgaaggatctggaaaacgcccgggaatttatttttatggagtattttgccgtggaagatacggaagtcttccaccgaattgaagaagtccttatgaaaaaggtttctgaaggcgtagaggtacgttttatctacgatgatttcggaagcataggctttgtaaagccggaatttatgcggtgtctgaaccgccagggaatccagtgccgtatttttaatcctctgattcctttgctctatgtattcatgaatcaccgggaccatcgcaaaataacagttatcgataatcacatcagcttctccggaggctttaacctggcagacgaatattttaatgtcacacacccatacggccactggaaggataccggagtccgtatggaaggagacgccgtaaaaagccatactgtcatgtttctggaaatgtggaacttcatccgggataccgacgattctttcgaaaggtatctgcgcgggaatacggccttccaaagtctgcagaaaggctttatccagccctattccgatactcctctggatgatataaccctgggcgaaaatgtatatatgaatatcctgaaaaacgccgccgaatatgtttacattaccactccttatctcatcattgataacgaaatgcagaaggaactgtgcatggcggcggaaagagggattgacgtacgcataatcacccccggcataccggacaaaaagcttgttttcctgctcacacaatcctattatgccgccctgatacagtccggtgtccgcatttatgaatatacgcctggatttatccatgccaaagactatctgtccgatgataaggttgccgtggttggcaccatcaatatggattatcgttctctttatctgcattttgaatgcggggtgtatttctatgactgtgatgccgtaatggatgtaaaaaaggattttatcgagaccttcccgttatgccgtgaaatcggtctggactactgcaggaaacgctctgtgtttatccgctgtttccagtgtatcctgcgtctgctcgcccccctgctgtaggatggcggtttcagccccttttctgtgcatccctgtacgacttcatatgcgccttcatttttttcatggcccagtcgtaatggctggaggttgctgaaacacagtatgagccaaggttggaagtccctgtccaggaaaaatgcttcttctcaaacagctcctcattggaatattttttaattaattccatcacttttctgtggctgtcaagaagcatttccctggcttcctcatacgaggtgtcctgatgctttttccagaattccacattcatctgtccataggttttccagttatacggagccgggataaacggcattgccaggcccttcttattattctcttcccagttcagcagcagctggtgccattcatacaggtgtaccagtatatcacgtatattcctgtctctctgccagtgcgcctctttcattttcacattttccccaaaatgaaattctgcattccgttcctccggtgtcatggaatccaccagtttccacattttatcgaactgctcctctgccgcctggatcaaatctgtctttgtcgccggtctgctcattttattttcctcctgataaatgatttgcttttctatgaacctatcatacaacacataaggtgacagctgtatgtcaccttatgtcatctttataaaagttttttatcctgtctgccatggaaagaagataatctcttacatgctgcggctctattacctttaccgcagttccgaaggacagaaggaagccgtacagccaggcatcattgggcagttcaatcgtcacggtaaaggttccgtcctcattcggatgaacggttctttcgtcaaactcatcataaacccgataggccgcttccgccgcaaaaagcagccgaagagatacaagggaatccggcctgatatcatctgaaacaatgggaggcggcgtgaattccattccagcaaagctttccggcagcacctccggataaagcatcctgtttattttaaaggttctgtaatcctgtctggccaggcaatacgcctgaacgtaccatgcgctggatttgaagaccagcttcagaggatatacggttctggccgtaagttccccattggaaccaggataggaaaaggaaagcggcagtttgtttataacagctctctttatcatctcaaacttttccttatccggattggtgcttccccaccgggaaaaatccacttcaatccatgaggtatccgttttctgaaacagcgcgccaagccgggatatgatgccgtccgtatccatatgctgtgtggaggcaaggctctgcagcgcaatcaggatctggttctgttcctcctcggataccgcggttttattgaggacaaagttatccattatggagattcccccgcccttcccctttgtggtgtaaatgggaattcccgctatggttaatgtttctatgtcccgcagaatggttcttttggatacctcaaagtgctccgcgagttcgttggcggtgatgctctttttatccagcaggatatatacgatttcaaatagtctgtttatctgcatgtctgctcctgtctgtatgttttggggatgtgcctgcatcaaggcggggaaagaatgtatctttagtttgccgccttatagctttactataacatagtaaggtgacatatgtacgtcatgttataagtaggaattaaaaaaagaaccagatttctctgattctttttttctgagttcagtatattcttattctctcatctgtccagcacaactatacctttttcttttgccagcaaactgacagcacatgtatccggccacaagcagcatattttataataaaatagaagcaatctcctcataaatctcaaacgggccgctgacaggagtcggcagcctgtgctttcctgtgtaatcctcatcaaaggtaatcggtgagccgtccggattttcaaataattcttccggttcaaatgcttctcccaaaagctttgttgaaatcatactattccttgttttaggcatatatcggaacagatttgtataaaggattaagtccccgtctttttccacaagctccagatcgatgtgatgctctgtgtctttcatatagtctctttcgccatcatatggttgagcaccattgaaatacacattacctccggaatacaccggcagatgatcataatatttatccctctcctcacgaattttataattattctcctgaaatcctgcaaaatattcttcggcgcttggatatccatcataaggtttggtgccgacaatatagttcatcaaatccagccgatctattttcctgtcttttgcataatccactaaaagctgtctgaccggctgctgtacaaaaatattattataaaatcttgcatccccgtgaagtatcgtcataaaaccatttatctctgttctgtgaggaacatgatatggtgtataacgcggtgagggaaatactttactcccattatcactgccgttcccaacatatacgaaagaacctgcaatcagattatgtactaatgcaattccctgtgtacaaaaccgtcccgcaacctctgataaaaaaatattattatccatcagggtcggcccatgagacacttccacaaatatatcttccgcaaccgacaaatgctctgtgaattccgtcccgtccggaggggtattcttatagaatatgttttgtgtcacccgtgtgccctgcgcctgccagtcaagccataagcccctggtacagtggtggaacctgtttcttctgattataacatctatggctgcatgcattttaattccgccgatttctgctccggcgagatcctgcttgttattaatatgatggatatcattgtcttcaataatggaaaatacaccgccgagatgtccgacaataccggtctgtccgcaatcatgaatattacatcttctgattatatgcgaaccaatattttctttcgtccacccctcgcgctgagcctgacagatggcatcacgctctgtctgtgttccggtttttgtatgctttaccgcccatttgttatcattttcaggctgcagatattttccgagggatataccgctgcatcttgaatgggaaatgtcacaatcttcaatgatccagccctttgaccagtgaggacctatcattccttcctgataagctgtgggcggagcccattgtgtcgcagcttttgtaatcgtaaatccggaaaccgtaatatatccgataccttcttcagaaggataaaaacaattccttctgacattcatttccacattttcctcattgggattcaattcctgaaagttggcataaatcactgtttcattctgttcctgtaccgtataccatttatacagggaacccttctgatcccaggagcccttataaatgacaggatgtaatacctcttccagagaatccgtttcatataatgccttattattaatataaatctcacctgtatgcatcggctttacggcatcataccagtctccgaaaatctctacgatataaggattgtattccccgaaaataccgttaggtattcttaccctccatacattctctttatatctttcccagttttttacttcttccgcccccgtaataacggctccgtttttaactgcagaacggtatgtaattcttctttccggcgtgcctgagaaagccggattgacatattccctgtacacccccggcgctactataacttcatctcccggcttcgcaataattgccgcctgagcaagtgaattcaaaggatattctttcgtaccgtctccgcctctggattctttagacacatatatttccatgatattcctccgcatttaaaaacaatcaaatattttactgttcactcagcagcttccagctaaaaccatccgcagaagtcagcagccccagggttgtgtggctgtccttatcctctcccatcaatatcatcatccagcaatcatcctctttccagacaaatggcgccccatattttgtagtaagccagctttggacaggaatctctattctccctctgctgtgccaatgaatcaaatccgttgatacaatataagccagatgctgatttttcagtccctcactgtaaatcataatccattcttttccattattgaaaaccgtgacattttctgcgccatccggagcctcttcacatgcgcctatcagcggcttgtcaacagtagtgattatccactttttcaattccggatcatccgtataagcatgccctaccagatttgttgcactctgataatgtactctgtctgttcccacaaagaaacaatgaagccgttctccttccgttacaaaggtgggatcgattacccggtttgcctgattccagggaagctccctcgcttcctccaaaaagaataccggatccgaccaattttttaaatcctctgacaggctatagcagagcatggtcggtacatccggatatgactgataaggcaggatatacttcccgttccattgaatgacatcgccgggagaggcaaagcccttgcctgatatatcccgatcattttcaaagttaataaaatctcttgtaaaggtacacgcaacagaccagttctccggcctgttccagtcattattggaataacgggaatagaataaataatagccatccgatgccttaaaaacggaagggtcccgcagattatccgatcttttccaaacaggattgtgcaattcttttatattcattttttcctcctgattcttattgagaaaggcagagacttccttctctgccttttttattataaccgtaaatttttataacagtactatcttatataccggtcataagcagcctgttctacggcaaggacatcatcaatccccatatccttaagggtctggacaaacttgtcaaaattatccagcggttctttgttcatgataaatttgttgatcatttcatccttataggtctgtatttccgtataggtactgttgattacttctctttcatcttccgtaaaggaaagggcgggaatggtaggacggatatactgttccatttcatttctgtagtcgacataggtcttgtcaagcaaagcatcctcatagccgatatcctgtttataagcccattctctgtgtccatagatgtttaacatggaaagaatcgatcttccctgttcatcctttgcgataatatccgtataggtaggtactccattttccatagtatacgtttcaccttctataccaaagttcattaacaggctgccttcttcactatagaagtaatcaaataactgaacgatttctttaatataaggtgaatcagcgcttattgcggtatagcctctgaccggctgcatctgactggtagtcatctgcgttccgtcaggacccttaggcggagcaactacaacaaaatatgcatcggagccctcattcgctgaagcgacctgtgtgcccagggcataagcgcgggcagtcgtatcctggcatgaacctgaaatttcattggtaagccttgaaagccatacatttgtatcatttgttgcatattcaggatcgattaatccttcattatacagcttattaatgaattccagcgcattcttacatctgggatccgtataagcgtacttaaccttgccgtcttcaataaaaaactgctcgttagcttcaaaaccgctgattccgaaggcttccataaaagcgagcacgccagcctgcgtatttcttgtggtatatggaatttcatcggcctccccatttccattgggatcctgttccttgaatgctttcaaaacattataccagtcatccagggtaaccggcacatccagtccaagcttttccagccagtccccgcggagcatccaaactttaaatgttcttacagcccctatgaacggcataaaatagatattgccatcactggctcttaagtcccggatatattcaggattctcatccagaattttctttaaattggacgcatactggtcaatataatcgtttaatactgcaaaagtaccctgctcggcaaccttcatcatgtcatcacgataggtgctgaccataatatcaggtatatcaccggaggcgactgttacgttaaacttctctctgaactgatcctccgtattcggtgcgggcacaaattcaaaattcacacccgtacgtttcgttatttccttaataataggcaaatctgtgctgattgcctgatccgccgaatcctgcaggaacatactcactgtaatattttccttactttcatcaccggattcatttgatgccgcagcagcttcccctgttcccgtatcagccgctccctgatcgctgtttgctgccgtatttccgcagcccgccaacgccgacacagaaacaacagccgccaataccattgccattacttttttcctaaccataactacctctccttttcctatcattcttttttcagtaaaaataccttgtgtttcctccgcccctccttttcctttatttctgtaacaaaaagacattatcagcctttcacagaaccaaccataatacctttaacaaaatatttttgtataaatgggtaaaccatcataattgggatggtcgccaccatgattgtcgcatattttaccgattcgctgatctgatccgaaccgtttaccaaatcaatagaaagatcgtttgtctgattttgaattacgatatcacgaagtataatctgcataggcaccagggaacgatcccgtaaatataacatagcagggaaataactgttccactgtgcaaccgcataaaacagtcctacggtcacgatgccgggcagtgaaagcggcagaataatcttaaataaaatttttatctggctgcatccgtccaaagctgcggactcctccagttcgtaagggatctgctgaaagaaatttttaagcagaataacattaaaagaggaaaccgatgtcggcagcagaatagaccataccgtattatacatatttaattttgttactatcaaaaatgtaggaatcattcctgcactgaaaagcatggccacaacaattacgctggacataaacttctgtcccggaaagggacgcctcgacagaggatatgctgccagagatgataacagcaggctgatcgcagttccggccaccgtataaaaaatagtatttatatatgcacgtccaatcatcggataagataaaattctcttatatgcatcaatgttaaaacccatcggaataattccgacctttccctgagcaagaaattcgaagctgctgaaggaggctgccaaaacatataacaccggatataaggctgctgccatcagcaaaaacaaaatcgtataattaatacattgaaaaataattcgtcctttacttactttcattttcccctccattaccacagacttgtttcggatgtttttttagcaaccctgttcgcaaataataccagcagcaaaccaataacagactgaaaaaatcccactgcggaagcaaaactgtattcaccgttcaatattcccctgcggtatacataggtaccgataacatccgccgtagaataaatgctggggttatacataagtacaatggtttcatatcctacatcaagcactcttcctattttcattaagaataaaaggacaatggtcggcgtcagtcccggaagcgttatatgcagcagctgggcccatcttcctgctccgtcaattcttgccgcttcatatagttctgagcttattcctgttaatgaagccaaataaatgattgcgctgtaacctgcggtctgccatattgtcattatcgtataaataatccaaaaataagaaggctccgtcaaaaagttaacccgttccataccaaatcgggccagtatattgttaatcagtcccgtactcggtgataaaaaggtaactaccataccaacaacgacaacgcttgaaataaaattggtaaatagcagcccgagagtcccgtttgcaattcaggattcccgttttgtaaatgaaaatcctgttttgtaagtgagtttcccgttttgtaaacgaaattctccttttgcaagcgagtttcccgtattttcatttgtaccttgatatgttataatgccaacagcaggatcttgtgtatgacaatcaagaatcaattcccgttcgaaatttttgtattcggagaatccatcccgttttacctttattttgatctggtttgttctggcagctcacacaagatttttgttacttttttagaagttttggctttaagatgatgttctcggctgcaaccggcgaacaccctagtttcttaagcaaatcttctccgtaataaaagctgaacgcatcgtatgggctacggttgttcagcttttttcttttataagagttgatgtggttcatcatcagggatatattagcctgggtcagatcatcaaagctttctcccttcggcagaatacggcggatcagttcatgattgacttcgcaggcgcctttttgataaggacaactcggatcacaataaaagatgcttgtacggcgcatcggtactgtatcccggtactcaatctcctttggattggaaaactcacttccgttatccgtaagtataaccggaaacagacggttgaaatcctttgccccaagaatacggtcaagcgcttgaaagatgtggatgacagaaccagccgtattggattccctcagaaaagcgagcataaaactggtctctacaaaatgaatcgtaagcaggcatttccctccgggttttccgatgacgctatccatttgtacgatggttgtctccggttctttttcaagaaatttttggaaatccgaataactgcgtcccagacggcaccccctgtctactttaaattctggctgtttatatcggggacgatactttaccttgcgtggcagatcgatattcctgatctcaaaaagctgagcgtccacataattatataacgtcttttcactgcacatcagctcatcgacatgctccgtataaatttgatggagggactgcccgtttttaacaagcggagtaatgagcttattgatcctggctatatcggattcatttgacagaatccctgtccttgattcagaaatagtcttgtgcgccatttcgtgtgcgtccgcaggatcataaatcctctttaaaagggtgcatcgggggagttcccggcagccgttgcaaacgtaaggtggtttcctcttaacagaacagatgtcctcttcaaaatcagggcaatggaaggtacattccgaacacaggctgcatttataggctgactgatgcgtgcatccattcgcaccgcagatttttttagctttacatgaattgcggtacttacatggattataggggtatcctggacgtccgcttttcttgtcataggaatatttccggatctccttggcaatcgttgtacggtcttttcccagttcctttgcaatagccccaaaagaggtgttttcctgaatacgctgagatatgatcagacgctcttcgtatgataaaaactttgacatggcgactcctttccggctgccagagatcaaagtatagcagaaaaggagaccaactttccagtcagtctcaatctttgcaaaagagaatccatacccttctcttttccccatgtaatataactataagtcccattcaagatcctgggtatggaatcttgcattacaattcaggcttgaaataaaattaggaagataggtaactgtctgaaccagttttttataacgcactcttccgacttcatttaaaagaagcgctaatataatcggagcagcaaaaccaattgttaattgtaaaaagtttatccctaaggtgttccttattaatctccagaaaaaaacagagtctataaactgtttataatattccagtcccacccatttactctgaaagataccctttgcaggctgatatttttctacagatatgacaagcgataacaataagggcacatacctgaaaaccacaaaatagattaacactggaataaacataatatagaaaggaatactcttctttatactattttgccggctttgctttgtctggctgcctggaaccttctttctccgattcgtaaaaaacatttcccgcacctctttcttagaatttagtactgcttctttcctgcctttttgtttgtggactaagaatatcattgctgcttagttgtgtaaatcttccgatttttagtatttgtggtcaaattttggatgtcacgggttaattctttcgatttcgctccgcatggctttttaagttcctattcacacaaaaaaacccctttctcaaaccatgagaaaagggctttttcttaacatattataattttctgtattgacccggcgatatcccgttatactttttaaacaccttgctgaagctgtttgcactgctgtaaccaaccagcctggctatctgagaaatattataagaactggtctcaaggagctcctttgctttctgaagccggaactgatttacatagtctacaaaattcaaaccggaattttccttgaatatgaagctcagataagaagtagacaagttaaccacttcagcaaccgtatcaagcgaaatttcattactgtaattttcttccaggtacgcgtctattttttcaagaatatgatattgctgtccatgtttattttctgccgcaaacaatgtgattgctttaaatacctggacgatatattcctttttttcaccgatgcttttcctgtattctaattccttgtagatatcctgcttttcccggaaaatctgatcatttgtcagcctcatttcaaatattactctcactgccgttcccgccaatgcatggaacaggttatcaaccatctcaggagacagctctctgccgttaaaattctctctgaatatactatccagcatcctggttacatcctcactgtttccggatttcgtaaccataataagctggctctcccgttccagaggatatgtaatcactgcactgttgctatttctgacctcatcaatataaatcacagaattctggcctttaacaatctgatattttattgtctcaagtgcatctatgtaagaacggtaacagttttggatgccttcatagctctgccctactcctattacataaggaaaatacttttgttccacaaaatattcctgtattttttcaagataatcatttatcccgctaagctcataaaacgatttcggcgcattaattaaagatacaattgtgcgatcatccttttccaggaaaaaatacttacactgctctccccaggtctgctccgcaatctccttcatctttaatgcatcttctttatacgattttttatactttttcaggctgctgggagtctcctcccctatttcataaacaattacctgataataattaaaaggaagctctatgccgatatccaatcccatattttcaaaatccgaatttatcttcccgttaataatgtcgtaaatgtatttgtcctgcagcattggtttatttttttcgaaattgtcctgcagcgtctggttttctttataaacataatcaataataccgtttattaccgtaaattcatcatggttttcatcctgtttcaccactgttttcttatcgccaataatattaatatagcttaaaatcttgttcattggcttgtacaggctgttaataatatataaagttaatataacagacaataatatactgatagtcactaccaataaagtaacatttctaatctgatttacgctttcctcaatataacctgtgggaatcactgaaatgtatttccatttaagacttttagactgtatatactgaatggtaaagggctttccttctaccacaagttccatcgtatcctgattatccgtcatttcagctaactgcatctgtacggcagtctgtatcaaattcaaatcctcagaatccgcataatattgttcattcgtatataccgtatttcccaaatcatccacaacgtagttaaaaactactttttcactattataattggtcatctctttttcaaagagtgattcactcatattaacaatgagcataccctttggggatttatcaataaagggcaatgattcagaaaaaacaacaacaggtatctgataggtaccccgataaatagtttttctcccaagataattaaaatcactggtactgaacaccttatcccagtcaatatcttctttatatttacatacttctgaaaaaaagagcgaacgctgatatttactctctgttcccaatacaatatctgatttcttaatataaagccatatatcagaaatattattattatttgccttaagtgcacttaaataagaaatggaatcctgaatcagttcaaaattatcataattactttgctttgacagatataatacttcattcagactgcggttcagcgccgcctgcataagattggcctgcaaagagttaatctcctgatcaatactcttttgagcctgcttcaagatgagcatgttactgttttgaacctcacggatcatcatgccggatgacttccgatatgaaaaaaatgacactaatcctattgacataagaaccagcgccattatatacaagaaaatcctgacaaatatgctattcaacctgaattcttttatacttcttgaaaaaactcccattattttaccatcacaacccaaatttaagttcccgcagatgctgtttgccagaactccccttataaaatatgaatgtatttactgctataaataaacatatcttattttatttcttttgtaaagttcattctggcaaattacgaacgtataggttctgtcatacccattcccttatcccttccgtccgccagcttccttttatattccaccggagtcattttcatctgcttggcaaatgcccggtcaaatgaacggagcgaattgaagcccgcttcatatgccgcttccgtaaccgtcctcctgccatcctgcagaagcctgcaagcccgcgacacacgcagcgtccggacatattccccgaaggtcatatgaagcttttccacaaacagatgggatatgtaagagcctgaaatatgaagccccgccgacaccgcctccagccgcagatcatcctccacatgttccacacaataattcagtatctgcctgagagtctgtgtatccgctgccgacgtgccctgcagcctcatccgggccagcagccgccccagtaatataaggaaattccccttcatttccgccccgtaaaacatatccgtctctttctgcgcaagctccataatgttctccatagcctgtttcaatttcctgtcccccatccctcctttgatcagcgcatcttccggcaccattctctgaaatacctgggaaaattcctccgccaaatccggctggaaaataaagatcatataatacgcttcctccaccttctcataacgatggatctgattggggaacacaatgaatacatccccctcctgcagcctgtattccctggaatccacaaaggctgccgcctctcccttcagcattcccaccagctcaatatgatcatgcatatgcgcatcataggagagatcccttccataatggatctgcagcggcaccggccgcttttcataaaaaaatttcacaaggtccccctttccgcttaccctttttccgcctttttgccataaagcttccttatttattatctgaatgacatccgtcagtcaaataagcatattttgacttgcttaattcctgttttggcttgtattataacatattttgtcttattttaacactataggctgtactgcaggccaaacagcataccggcagtgaaaaacatcggctgccgtccgaagcattcaatgggtctgccccgcagcatcggaacagctactgcaaagaataggaggatttattatgttttgtccaattgccttacagctttattccgtgcggaatgagctgcagaaagattttccggtaccctggcacaggtgaaggaaatgggttacgacggcgttgagctcgcgggcctatgcggttattcccccgaacaagtgaaaaaaatgtgcgaagaagccggactggttcccatctccgcccatgtcccgctggcggaaatgtccgcggatcccgaaaagaccatgaaagactacgccgatatgggatgccgttatattgccatcccctacctcaccgaggaattccgtccgggtgcagaaaattataaaagcttcaaaaaagaagcctcccatctcggagaactcgccaacgctaacggcatgaccctcctgtaccacaaccatgacttcgaattcgccaaaaaagacggagaataccttctcgatatcatgtaccacgatattcccgccagcctgctgcagaccgaacaggatacctgctgggtaaaggcctccggagtagatcccgccgcctatatccgcaaatattccggccgggcgcctgtcgtgcatctcaaagatttctataaatccggaaatgccggtgtttcctacgagctgatcggtctggaaggagaacagcaggagaagaaagaggaaggaacctttgaactccgtcctttaggacagggaatgcaggatatcccttctatcctgaaggcttccgaagaagccggcgccaaatggcttgtggtggaacaggatgatcccactaaagggctcactcccatagaatgttcccgcatcagtttacaatacttaaaatctctggattaaatccaaaatataagcaggaggaaaaaaatgtctgacaaagtattatcccagttcaaacccgaaactcacgaagaaaacaccattgactgctcccgcaggctgaaattcggcatcataggtaccggatggatagcggaatcccatgtggaagcgctgaaacagatgcccgatgtggacatcgtggcaggcgccgatttaatccccggaaaggcagaagccttctttaaacgctatggcgtggaaaatgtacgtctctatccttcccacaaagaaatgctggaggctgaaaccgatctggatgcggtatgtgtctgcacctataacaaaacacatgcggaatgtaccatcgattccctgaacaagggccttcatgtccttctggaaaagcccatgtgcgtaaccacccaggaagccctggatatcgtccgtgcagaaaaaaagagcggaaaaatcctttctctcggcttccagccccgtatggatgagaatatgaagatgattaaaaaagtcgtggattccggtgaactcggacgcatctactacatacagaccggcggcggccgcagacacggcattcccggaagcaccttcattgaagaaaaaacagcaggcatcggcgcgctgggtgatatcggctgctactccctggacatggtcctgaacgccataggctatcccaagcccctgaccgtatccggctaccgctccaactatctgggcaccgatcccgaattcaataccccggaggatgccgccagattcgacgtagatgatttcgcagcagccttcatccgtctggagggcggtatcatcctcgatttccgcattgcctgggccatgcatctggatactcccggagataccatcatcatgggaacaaaagcctccctgcgcatcccttccacagaatgctggaacggctccatcggcggccccatgaaaatgtacaaggatgtggcgggcttacccgtggaatttgaatttcccatgtatcctcaaacggacaacggccagggtattttctataagaagctccgttcctttatcgatgcaattaaagaaaacggaaccgctcccgtgccctccagccagatcctttacaaccaggctatcatcgacggcattgtacagtctgcgaaagccggcaaagaagtggaaatccatctggaagaaatctgacagagtgtattcacaattgaattttttgataaagcaaggggactgccgcagcagtccccttgtcatatcaaaaccttactccctgacatctatctcttttattcccttcaatcgcccaatcagcagaaatgccagaatcgtaaacaagcctgtcagcaaataaatctgaacaatcgataaagcaaccgataatcctgcaagcagaaaagaacccacaggcaccgaagaacaggccagcgcattgaatatactgctgattctccccaacagttcctccggtactctggtcataagcagaacctgcatcgtcaccccgaacagagaatttacaaacccgaatacaaaagcagccgcaaagtaactgatatacctgccaatatcccatgaaacaaaacccaccaaaacataggcaaaataaagaagcccgattaatacacctccattcagcagaatccatttatccgatattttctgtccgatcacaggcaaaagcaaagcccctgttatcataccaatcgtaacagccgtactccccaccgacatggcaaacacatccaattttaaatactcactgatataagccgcctgcagattctctatcggcagtgtacaaagatttaaaatgatacaaagaaagcagatcattatcgctaaatcattgcttctgaaataatgaattccctctttcagcgaagcgaaataactatccggctccaattgataaaccgaagtattatctgccgtaacttttatgaacaggaagaatattccagacaaaataaaagtaacggcatcaataaacaaagcccctccgatgccaaggcttcctattatcagtccggcacatcccattccgaccaattcagcagttctgctggctccctgattcagggaaatagccgctttataattatctttactaagtattaaaggtaaaagggctataccgttgggaatcctcaatgcctctatcgtagaattaatgaaagtcaatacgatgagatgccacggctttagaacacccagaagcataaacagccccgttaaaaaaacaacagaaccccttaaaaaatcgcagataacaattacttttttcttattaaaatattccgtcagagcccctcccaacggctgaaaaagaactgtgggaatcatattaatacccagtattactgccagccatgctttcgatcccgtcagcgtataaaccatccagctgtaggcaatggcgtctattgaatcaccaaagcggctgacgatattggcggctataacatatcgaaacttcttttctgtctttataatccgggtgtagaaatctgctttcatcttcatactgtccttttttaagttatatatttattatcggtatattacatacaatatttataaatatatttcacttttttaattcgggacaatatcatgaattggattcccttgtcctgttaattgtttatccgtcagcaggaagcagcaacgccacggttgtcccctttccctctttactgtccaactccaaccgcagcaggaaaagcttatccacagacatgccaatacccatatcctttaccacaatgcggtgatcatttcacaggtctcatatacccccttcatctcaaccatacatttaatcatgtccaatgtgttatacagaaaatggggatttatctgggactgcagggatacaataatcgcttctttctcctttatctgagtcgtatacaccttattgatcaaaatatatcaatccgttccgccatctggttaaatgccctgcacatatccgccctcctgcagaagcttcataaacgtcgtctcttttttgggcaatggcgttatataacatggagccccgcactgagaaggataccttccggtaaaaatcgccgctcttgccggtatacaggaaggattggtggtatacgcataatcaaaaacaaccgactcttctgcaagagcatctaaattaggtgtctttacgcagggattctgatagccaaccgcgtcaaaacgctgttcatctgtcataataaatagcaaattgcaccttttcattttaatcctctctgtatttcatttttctctgtttgtatttttattgtaacccggtaactgcatcctctcaattctcttatttttgttacatggcggaatttttttggatttcaagaaagaaatggacgacatgggattactgctggtccgccgcttcaaccctaaatgccatttccggccaaaatctgcaaaaaacggccaaaccattgcaattcatcatttgttattctattttgatattaattagtaagacaaagaatagaagattataaagggttctgtggattttgtactccggggcagagagcgatatcttcattaacaattgaggaaagggagaatggtatatgaaactatggaagaaagcggtatcggtactgttgggtttctgcatgatgattggagggctggcactggctctcaggatggatgttagagcggcaacccttccggtacaggtatatgtcagtcccgggcagaccgtaacgattaacaaagattggactaatatttatatgaaagacagcagcggagcgtgcgttccctttaccgcgtattattatgacagtaatggcaataaacagggtgagagggtaagctccaaagagtatgacagcgaatatggaaagaagaatgaatcagtctatgcagattttgtatatgtgtctgtaagctgtgaacaaattaacggcaactactttgtgcatatttatgaagaagtggattctcactcaaaaaaggatacccctccctctgacagcggggcttttaacagtgaaagctgtcaccacaatttcgagtgggtgacggtacaggaagcaacggcaattgccgatgcggttctcgcatatgaatgtacaaactgcggccgtgtcacggattatatgaaggagccgaactctgcttttgctcaatttaataaggaaagtatcgcatctatcgaaactgctcagaaagacgcagcagtgacattggatactgatatctggaacagcttccagggaagtgttttaagcgccctgtcttccaggccggacattactttagtaatcaaatacagatatgaaggaaaacgatatacagtcactattcctgccggcagcgatgtgctttcccttatcgatgagaacggatactgcggtttccgcactctggattcccagtttggagggaatgaactcacagtcggataattacaaggccgcaatcggataataggattggagtctgtatctataaatagattgaattttaaccatagtaaggtattagtgggactgttgcaaaagcagattaataattgctggagcaatggttccttttcccaaaaagaaaaacggactccgaagagtccgccttctgtagcataattacacttaatttggggtttaagttggggaagtctgattccggatgatgattctgtctgacggctaagtcacgaattggaggatttagattacattttcaaagctatcccctatctcattcatttttgcatacatcttactcttaagctcttccgctatttcccgatatgatttattatcaatcacgttttccatctgataaggatcatttttatcatcgaacaagaactcttggccgtctgatttaaaaatagcataagtatactgttttgtccgatatactctccattcatttccatccccaaatatcacagccggtccggtacacatcatgagggcgccttcttccgtatcggcttccccagtaatacaggcgctcagatcagtcccttttgtttcttttggaacagggagtcccatcgtagataataggcttagcataacaatcaaacatatatctggtgggctggtaaggacaatggctcttgtgatcaggtatgactgaacattgtttctgacgataagtgcattgtccttttctatcgagcggacgagtgaaatttctttatcagcagcaaagggaacctgtaaacaataactctttatttatacacatatttttctccgtcttttgtagtgccatagcgtttgccatattttttatcaaatatccttcaaaattatcccgatatggattaaatcacatagtttctcaagtattttgcactcagcacaactgccttctttgcttcctcgagactgccttcaaacgccttatcttctacttcaatacaggtatatccattgtatccgatatcggtaagggcggatacatatttgccccagtctacatctccgagccccggaagtttgggtgacatgtattccagcggtgtcgccatgattcctacatcagcgagcctgttttcatatactttgatatctttgtaatgtacgtggaaaatcttgtctttgaactcatacaatggcttaatataatcaattctctgccatacaaaatgagacgggtcataatttatacctaaattaggactgtcaagaatctcaaaaaccttcctccagtttgctggtgaggtcatcaggttttgtccccccggccattcatcttcagtgaatagcatcgggcagttttcaatagcaatcttaacccccttctcctctgcgtatttcaaaatcgggggccatacctctttcacaatttccagattttctgtgactgtcttatgtggatccctccctataaaagtagtaatcatattcacatccagcattgccgatgcatctatcagcttataaaggtgtgctatataagccatcctcttctccagatccggttccagtgtgttcggatagtatgcaagagaagagatttcaacgtccctttttttacaatactcattgatgtattttgccttttcctgagtcagaccggccacatcgatatggctgacccctgcataacgcctcgacgcgcccccttgcggccagcatgcaacttccagacattccagatggttctctgccgcaaagtcaacaacctcttcaaaactcattccctcacatatcgctgtgataaatcccaatttcatgctgtaacctcctattctactttaaataattctgatactcttcttttagttccttaagatttggtatttgtccggggccgactgcttttgtcttaatctccgtcgaatgttccagtttaccatcccaccttaatcttgagcgttcctgttcttccttactgaatatggcgcggatttttccgttttctattgacaggtctccatatatgccgcagaccgggcactctatagaggtatggtctttcgatacggtcagcatactgcagtggcagactgggcagattccttcctcttctccgcgccatttgatacgctcctcctcggtctctgcatccaaagcagaggcaatattgcggcctatacttctggcacgttccatctctgaatcatttccaagtacatgttcataggccatagccccaaaatactgatgcatgtctatcacatcgatccccatcgacatagtaaattcatacatggtaggcagcataaaggaaagccagttttctgtcatggcgcctcccacggatagcaatgccccaatacgttttttaaagcttctttcatccgggagctgatccacaggctttcctgcttttatgccttcatcaaatgttgcttttctgaaggtgatgtcatgggatggtccgatcctgtcgcagactgttttaaatcttcctgtcggtgatagtacataggtcggacttcctacaatcactgcatcgcattccataagcgcctcatcaatgatatgcatatcgtctttcagaggacagccgcccttcccacgtcccgtcgtcattcccacgacgcaggaaatacatcctgtacaggctttgatatcaaggtcatccgcacggataaactgtacctcatgtcccgccttttcacactccatcagtgccgcttttatcatgacgtctgtgtttcccatctttcttccgaaggaaattcccaatacctttttcttcatcttttgttctcctgcgcaatctctacttcacgttccatcgtaccaacaatcggcaccggaatataagcagttcttgtagatactgtcagttccaccctgtgggtaccctccgacagaccgttttccttcagtacccttatataaagcggttccccgtactcccatttgtatgatgtcactgtctgcatttcatctaaagtaaaccagtcttcctgatcgacactgcagcggatttgttcccgcagaatctctgtcccgtccagcttcacttttatatcgttcaccatagataatggaatggcgcggtaatatgtaatatgggtctgcagttcgaacccgatgatctgatggtcagccatgatatttttgcatgttccttttataaatacattattatcaaacatcgtttatccccctatccttccatttcctgaatgtatctgcgaatcatttcctggtgtgcggcaacctgttctttttcaaccataggatgccccggaagaatccagcggtttccttcatattctgttgctacatatccgtcataatcatgatcatggagatactgaagcagccccttataatcaacagagtattcctccccatcagccatctcccacagcttaaagtgaaaatgcctgatatatttcatgtatttgtccagtgtttcatacggtgtattctcgtatccgtcagccagcataatatatggcatatccttttctgatgcaatcgctgcaagctctggtttcatattatgatgttcatcaaatgcatgggtaccgtccagccccttgtcaaacaggctgttaaaataatccactacctttggattcgttcccagtaccttcatattatagtcgttgtaaacccttggaatcctgcggcagaagatgccggcatctacaacgagtccgcaatacggggaatccacacggatcatttcctcaataaatccccttgtctccggaatcccgaagctcatgcctgcatgtatttcgagggcaaatgcaacgtcatatttctctgcatacggaagcagcggttcgattacaaatgcaggtaccatagatacgaaacggattaaatgaaatcccatgcggtgtgcaagttttatctcatcaatgagaaggtctatacactccctttttgttaacgtccggttgttgtacaaatttgtatttaaaaatacatctgaacagactggttttattttataggtctccatcaggtaatcccagtgcttcagcgattcctcagacggatgcggtgtattgtggatcatctggtccggaaggagttccagaccctcaactttattctctgccagatacttcatgatgtcttccagagtcatcctcttattcatatactcatcctgaaggctgtacagacttacgcatgttttaattgccatcttatctcctcttttctttattcaaaatctacggacttcccggtttctgcagattttctgactgcatccatgactgccagaactctccgtatctcgggaattttcacaaggaaatcatcttctccgtaataggcttttttataattttcaaaataatctctgtggcaggtattcaccttcggcacgtcttctgttataatttttcccggtgcaggcggtccgaaggaacgtgttggtcctgcagccgtcattgtcctggagcctcttacattcgtaagaagctctgttgtcctgacaatcttcccttccggctcgaaaccgtccacatatgcggttcccttgtttccgctcataatccagtgccgttcgaaccacttatcctgcggtttgtcagctaacaaataggttcccagttcaacttccgccatcacgtggttatcaaacctcagcaggattttaaaataatcatccacttcaaaattaatgacatttctcacatccgcatagatggatgtgatttttgcttccggcatcatgaagagaatctggtcgatcaaatgtactccccagtcataaagcatgcctccgccttcgcttatgtaaacatgccagtcatgcatatttccattaaatccatagagactgtttttcatcatataaacgtccccgagagccttttggtcaaagatttctttcatgatcctgaaatcctgatccagacgcctctgatggtgaaccgtaaatttcaccccgcactcatttgttacgcggaccatgtcatccagttcctccaaagacatggctgccggcttctcacatataatatcttttcccgcttctgccgcctgtatgaccagatcgtgatgctggttattatttgccgcaatcagtacaacgtccacttccgggtctgccaaaagcacctcgttgctttcgtatctttttaacccttccctgacatcgtccaattgtttcggatccctgtcagaaaatccgatcaaacgaaagccttccatctgactgagcattgtctcatgctcatgtcccataaaaccatggccaatcactgcgattctgatatcttccattttgtcctccaattcaacccctgctttttaatccagcttgatttcctgacccgtctcagctgctttatatattgtgtcaagaatctgagtcactacaaatgcctgctgcggttttacaagcggctctttatcttcgataattgcttccagccactgtttacattccagcacttccggggaaccgccgctatttccttcaaaaaacgcaattgcccctgcatctgaaatatgctcttccgttaaaattccgccggttgtctcattgaatacaagatcatatccttcctggctcattccgccaatcatctctgcacctgcctttgttccgcaaagggtggcagccgcctctcttgaatccttgacattcagtgcccatgcagactcaaggaagatcgccgcgccgtttttcattttgatgtaaccgaatgctgaatcttcaacctcataagtctgcggatcccacggtccaaacatattgccttctgcagcttccggaagatgccccagtttttcaaaaacagatcctgtaatggattcgggctcatagttatccatgcaccataatgtgatatccaatgcatgtgttccgatatcaatcagcggaccgccgccctgctttgacttatccgggaacacgccccatgtaggtacggctctccttctgactgcatgtgcctttgcaaaatagatctctccaagtttcccttcttcacaggctctcttaagtgcccgtgcgtctgtacggaaacggttctgatatccaattgtaaatttctttccagatttcttccatgcatccatcattttctgtgcatcttctgttgtcgcagccattggtttttcgcaaagtacatgtttccctgcatgaaaagccgctaccgtaaccgggcagtgtgagttatttggtgtgcatacgtgcacgacatcaatatcttcatctttcatcatttcgttatagtctgtataaacttttgcatcgggtgtaccgaatttctcagcccccgcttttgcacgttcttcaataatgtcacaaaaagccacgatttcacatttatcactctgcgatgtaagcgccggaaaatgtttttgatttgcgattcctccacaccctacaactgctacctgtaattttccattcttcatcttcatttcctcctgattgttttttgatttaattattattttctcttaatttttgacggatatcatctgcatccttgtcactcatattccataataaacacgcaagtgcggccacgatgaaaagaattgccggaatcaagttaactaccgtattaattcctttcaatgctgatgcagtctgctcagcatttgccacataaccaaaagccgccagaagaagcactccgattgaaccacccagtgcattcccaatctttgtagccagaccatacgttgcatatgccgtcccgtctgtcctcactccggtctttaattccatataatctacggaatctgacaccatcgataacgtcattgggaaaccgacattaaacaggccaaatatccagcatcctgccagaaccattgtcatattgtcaaacggtgcaaaataaatgactaaaagcccgactgcctgaatcagcatggatcccatcaggacatttctttttccgaatttttttgccgccatcggtacaaagaaggaaccgattacagcgccgatagaaggaatcgtcatgataagggcaatcaatgtaaaggaaccaaggcaatagataacataaaatgcacacactgcgatacgccccatgaatgccgtcatctgaagtgtcattatcagcatgacgatcatcaggtacttattcttaaccagattattgatcgttgttttaaaggaaaatttctgtatttccccaatcggctgcacattttcttttgcagtaaaaaatacgatcaaaaacagcgggatggctacgattccataaataacagctaccatcatataaccgtgtccatttgcaacttctgccccggaacctgagaatttcagtgcaagacctgcggaacaggcattcacgataatcattccaagattcatgccgatgtttctggatgtattaatcgtatttctctgtgcggcatcttctgtcattacacctgccagggccgcataaggaatattggtcaatgtatataacattcccgctatgatgtatgttgccgctgcccatataatccctgccacactggaaccaccgaagggatttgtaaatgtcagaactccaaacaatgccagaaacggacatccaaacgctatgtacgggcggaacctcccaaatctggaacgtgtccgttctgcaattgcccccatcatcgggtcatttacagcatcccatatacgggcgcccatcataattaccgacacaatagctggggcaaggccgacaacatctgtgtaaaataatgtcaaatacgaaccaacaaaagtccatacgaactgtgatgccagatctccgaaaccatagcatatgactgccgctttcgaagccctcttttgattttccataatactttctccattcattattagtagtcacatttcacatttgaattgtaagacgtcttctcaaattcattttgtaagataagtatatcctgagacagttttatttgcttttatatagtttcaaaatacttgtctatttttgccatatacaacaaaaaaagaaatcatcgcaacaaccatactatgattgttgcgatgatttctcccatttagtatttcttagtaatccttataaatatggaacaaggcaatttcatgaggctgcaactcagaaacaaattcaagctctccctggccggaatataccctttccatgctcagatgtggtgcacatatatttcttaaatacttcacatcactccctgaaagctctgcctcgcaattaaaacggatccattccgtaagtatgcacccatactgattattcagcagatgtttttttacgatatatttctggtctgatactacatttttaagcctgaaggaaacttccagtatcttgttatcctcaaaaatagcgtccaaattcctgatatccagatcatcctcatctttcatataataattggcgctgtaccacttaaagttaaaacacacgatataatattcgccatgttcattagccgtcacaatataattgtttcccgatgagacaaataaaggtcccaactggttaaggaagtcaattgcataataagccggttttcttaccccgtcttttgtaagaagccctacccctccctgtataatatttacagaatcataataagtactgatccagtctgagcccatccagaaacaggccatatccaccctgccccacatggcagctgtcattttcataataaacgcagccctgaaacagctgtcattcaaataattccgattggaaagggcattgctccactctgtaatacacagcttcctgtctgcaacctggcattcccgcatgatatttttcacgatgtcgatttgttcagaaaggaaatcaaaattagtgatcctctgtgcataattgacatcctgttcatcgctgagtgattgatatggaaacaaaatcattgtcacaaaatctggaacacagttctcctgccggcattgattcaggtaggttctgaatatatcttccttcttatctataatgatacttggtcccccgatccgggcccccggcacagcttccttaacctgaaaataccagcttttataatacttgaaaaattctgccgcgtcataaccatttttctgatgctctacatcaaacgtgtattcataaagccagctgctgatttcgtcaagaccaaaccttttcgcaatatgccacataaagcttctgacgatgttttcccattctgcctttgtctgatactccatcgtctcttcttcatagaacagcatctctttcccgttttttaccgcacattccggcctgctgccgaaatcaaggtatggtttaataccgtgggacaccagaaattccagtattgtgtcaatgctgtcaaaattgtaatttccccttctcgaatcctgccgtatctttaatctggtagaaaaaagattccatatgcgtacatattcaaaatgaagattctccgccaaatacagcgtatggtactgcaggttggccagtgtcaggttataagcagaaccgatattaatgactgtattccagaatggccggctggtctttgcagtctttatgtcattttctatagtaatactgctgataccttgacttgactggtccgtattcaccagtttttccagcttgcgttttactttttcttccaaaaataagatgtcctttgtttctgcggcaacatggggcttattcttttttctgtactgtgagggcggcatcccaaaattttcctgaaacactttgctgaataccgatggattcgaaaacccattgtcaactgcaatctttgtcaatggttcatctgaatacagcagatcattgagtgcataatgcaaccggacacttgaaacatattctgcaaaatatacccccgtctctttcttaaaaaaccgggataaggaagacggggataaatataacttttctgcaagagtattcaggctcagcaggtgctggtaattcatattaatatagttaatcactatttgcagacgctcactcggatcttttatggattcctgtctcccaacctgatactgaacgaggaatttttctatcaggcagtctaaaagttcatatttcaggctatatatcatacagtccgtacggtgctggctttcaagtacatgatatacaatcttattcagtatttcccgcagtttcggatacggcctcgctgtatcggcggcagtattgcagataaaagtgaaacattcattctgcataacatccgccaggacaagataggatatttttattgtaaacgcaattgtcttatcgccgcagtcaaactgatgcacagtccccgcattcacaagtacaatcccatcttttccaaaggtgtatgctttatccgcaacagatacctttgcttccccttccaggacatacaaaattataagttccggaacggatgccttttttcctcttctgtcttggatcagttccacttctatcccgtcaaacttccacttttttatcatctgtcatcgcctttcacctaaatcttcttttattttatcatatccgttcacgtctttctatttaaaagaagatgttgtgactttaatgcgtgtattggaacatagcatgaatatagtataattctgacttcattatatccagcagtttactaataaactttttctttatactccatgataaatccacagcatccatttcttaggcactaatatcatttcttcatcacgccccgttaagttatatcacttttctattttctacttagattataccctgcgtgtgtattatctgcaatattactcttctgattacttccttcgccaaataacagaatcatacttttacccaagagaattcataaacacaggctggttattgaagctagaagtttcaccgaagatggtatttcttattatgcaacagttgaaaaagacggtacaagccattaatttccagcgtcatatcgggttgttccatgtttaatatgtgtaaaggccacaaagcagcaatagatctgaccagcttttgcccttaaattcataaaaggaattctttctcggtttgtgtcctttgattagcctgataaaggcaacgtcactttcacataattccaaaatatggtcaacaatactcacccagcacatatttggataggtaaccacagaatacagcatgattgagttatacccggtacttcccttatctgaataacaggcaagggagtccgaaaaatctaattcctccattacttttttcagagtatagactgaatcgtcatcggctcctctgtttagaaccatctatttcccgacagtcctccgctctctaaaatgaaagtaagaaatacgcaaacatgagtaaacgtactcagaaaggaggggcactatgaaaaagaaaataaagcctatccgctgtccatattgcgggcgctccgtcgtgctgaagaagaggccaccaatattttgattccatctggaaaaacagaattatgacaaaaaagaatgcctattgctggctccaggacatcttttccatgaacgatgagcaggcccatattggccagttctccgattatatgtgtgaacaggtgattatagaaagcaaacgggtactggagaaccaccaaatcgcctgctaaggcagaaaggaatttgtatgaatatgatacagtgcacaaatgaacaaatacatgtggaggattacctttatctggtatccaccgtgatttctctttatattacacctcatactgacatcaccagcatgaaatatgatgacctctaccagaccggctgcctgacactttgtaaagcaaccgcatcctaccatgcagaaaaagatgccagctttgctacctatgcggccattgtcatccgcaatcagttctatgattactgccggcgcatgtattatatccataccaggcttttatatctggatgcaagcttgtctgaggagggaaaagataccctccttcaaagccaaaggattgatcaaactgtgcaaacctctgatatatttccactactactagaaattcatgaggaatacagtggtattaccgccaaaggtgtggaagcactgctccttcggaataccggctatacagacaaggaaatcgccaaaatgttccatgtaaaacccaatcatatatctgcctggatatccagggcaaacagccggctaagaaaagatccccgtattctggccgccgcagaataaaggagagtgaaaatcatgctgacattatatactgctgttgggaactatcagataaaacgaaaaccgaacggaaatttctatccggttgttatccttggcaacaaggtgctgcatctggatccgcatgagatgctgttatgatcctctctggcctggaacatccttacccatcaggaagccagggcattattttacgaaaaggaggccgaactccatattgtgagcgacctggactttgaacactacttaaaacggttgttattccgaagtttagttgccttcggaaccgattacactggtatcaacgcattatatagtctgcttgatcctttatatatccgttccgcagccacaagtccggctgcaaacctgggagcgctggcagatctggttttcttaaagcattttcctttaaaagcagctctggctgtctttaggaaagaccggttgacttccgatgaaaaacgactgctgcaccaacgtaacttagaagcactgccaattggaagacttctggattctgagggaattcaaagtaccaatcctcccacagtcattacactggcaaatctgtattttaagaaacagattatttttgatactgtatagaaggcttccgatgtacatctcctctattattttaaaacaggtggcctagacataccttattcccagttattctctatctactcttccaactagctttttctatcttcaaactaattaatacctgatcacataattcattgtaaataacttaagcaccatctatccttcaaaaattgcctgtggaactggttgtggctctattttacttgatttttgtttaataatcataaaaagaacggggattgtatccaataaaattgcaagtagcaacgatatcaatgctaaaatgcgatgagaactagtaagatagtatacagcccgctccacctgattaagttctgttaatatgttacgctgcatatccgataacttttcgtacgtcttcatcacatctggattagacgcggatggaagtttgtaaatattactcttcagaacaacaaattcatcattccaggaatttcgccactgttctttttcttctgaagtaggaaacaaaccaacccattgctctgtagttcggcatatatctgtatcactggcactctctgaacagtaaatctgtacagaccgtatctggttaagttctctgaataattcctgaagcttaagattaccttccaaaatctcagtgtacttcaagttaccaccgtcttcttgcatggttgatattaactctgtacatatttcatctgccaaaacatttgcattattaacgtttgggcttgtactccctaactcagcaagaatttgagcaaactttgatgataatatactttctgcagtattggccttaacccaaatatagttttttagagcattaatttccttgacttcatcatcttttttgttaatatctaactgcttggctgattgttcgattaacaaagtttctcgcctctttatctccaagtctttttcagcctctaggctcttaaatgctttacttttggtggcaagaggataaatatcaagtgagatatcatgaattctagtattacaattggaaatttggagttctagatcattatattctttctgaattatctccctttcggcaactgcattggctagagcagcagttactatttcttctatcttagtagaatctccgagaatcttgccctctgaagcattctcacatttctgaataacagtaatcatctgggcattttctctgaaatattctttcagtttctggaagtcaggaacaacatcctgtactgcttcatttgttgaaatatcaataactcctgctaatgcttgcagttctccaataaggttagtaacttcctgtaatttttccgtaaagtccatacttgcaagctgctcaagatcaattttttcttttctatatgtatctgtaagcaaatcctggtcatctcgcatatatatggtatcatatgcgtggttacaaaggtatacaaacgaaaagccaatcgaccacataccaacgaatacataaactgcccagataaataatctggttctaatattttttttataagtcagttttggcaacatctgatttaaccatgccaatagtaactgaattacactggaaaccgcaattgctgcaataaaactactttgaaaaaatgtatcactcataccctgccctgttgtaaaaaatgatacaattgcaattaacccgcaacaggctatgggaactgaccatatattctttttcttcatcctctgattttccacgatttattctcctccattgtgtgcaagttagtcgtatctattcatccaatatttctcctaaattaggtagatttttgataattatagcttcttaaattttaaatttataaaatttcatcatcctgctctccaaaaaacatatcataaagatatttaagaacatctttaattccttttatcataacagtaaatacatctggtatactctctccaatatcaagaattgcaaatatcatatttttgataatatctccgattctctgagatatttcttctgcacttttacggagttttccttcaggctgtagcatggaacataacaacttatatattacaagagtcataaatcctataaaggccagttgcaatactgtgagtaatagagttgcaatttcatctgagccgcttataaaaatgaatacatcattgagtgtgcctctaggtgcaatcatacaaacggtaatagccattagaaagctaaaacccaataaaatattactgtcatgaaaatgaaaatctgtctttgtacctttcataatctggatcatccgctttagaaaactaattgttaaacaacctattgcaacaattgctattagtactacgaaataccatacagctgcataaagaagtaaagataaagactccagactaaacttcttaaaataatcctgattttcaatcataacatagcctactaccaatgcaagaactgcaaaagctaccgcggccaaaaaatatccaaatacatgacgtgcctctaataaattttgtactgcttcttggcttttagtttttatccgagttttctgttccatctcattatttgtagcggttttctgcttattattagctgtcaaattagatatactgctataatttaattcgtttgatcctgctactggcatcggatttccattagacgaattttctactgaaagtcttaaatcaccatcttttaatgattcccttttcttatatacgccatatacattactcagactggcacaaagtacaacagttaagattagaaccaaagcagctaataataatgtactttgggaaatgtccgcaagaaaaggaattacagatgtaatagtcttccaactataaaggtcgttggccattatgacagccatcactaatattaaaccattccttagatagttgtttttcttttctttttttctaattataaggtatatttgagagcaaattcccaaaactcctatgacactacagaaaaaccttaaatcagtgtaagttccaaagaaaagaggaaatcctatcattaatattataataagtaaaattcgtcttccccacaaaattactttttccattatttcctccttgtaaatttctatctacaattaattgataaaaggtataattaacggtttccggcaatcattacttctctggagtatttagttatcaaagttcattaaagcaatttaaaatttttcttcacagtttgtcttaactttgtgtctatggatgaaattatgcaagaatatgcagcagaatactttgctatctaaaaacacgttgacttgcggaaaaacgtgtgatacgataatatacaaagtaattcaatttggatggactttgtaatggtgtttcttaaattagaaaatcattacagagagtctaaaacaacttaaaaggcataagaaatatgtgagtaaagtgtgttttcatcctagattactacatatattttcaaaaggagactgaacttaccagggtgcggtctcttttgtttttttataataacagatgtattatgtattgtaaatagaatcttaattttttataaagattcaataaatattactttattttaaattttgttgccaattattattttttttatattttatttgaaattgctgtaatttattgtattatagtataagataataaatattaaaaattttatatgtcatattttgtatctgattttgtacaatttttcacgttaatgctgggggaagaaatgggaaataattttacttatgatgaaatttgtcaacagatatgtctgtttttaagagtaacaattcgaaatcagaaaatgattcaggaagatgtagtaaaaaaatgtgaagacaacggattctgcattagccaagcaactatatcaaatattatgaatgaaacagggggcaaaagtatctcccttcgtaccttgtttgctatctgtaaaagtcttagcataccaatgagtgaattattctatgctattgaaaataatattaatatttatgataagttaactcaatcgaagcccaaaaataaaaaccgttatttttatcttccatcagaggatgcttacgatggttggtttggtaagtatcatgtatacagttttcagactaataaggaaaaatctctgttacatggtatactaaatttagatcctaataaaccggcagttcataatagccaagaatgttatgcggagttaatattatatactggtgaaaataaacgttttaaagagtatcaaggttctgcagttgcttctaaaaaaataaatgctatgtattgtaggttagaaagtgaaaaaattggagaaattatatatcttactttttaccattggccttttaccagtagtaataatgagcttgtatgtgaaatggcagttgtgattaccacctctagtggccatcaacatcttccaacagctcaaagaatatttttgtgtcgtaaagaactttcagaggatgagcaggaaatattaaagggacaccttcgtttaaataaagcagaaatgttactctctgaaaaagagtacatagattttattaaaaatacagatatccctgaagaattccgggcacggcttaaagaaaaggcctctaaggaaacatattattcagtggcagaatctgaactaatgcttaaccataaagaagatattagctttataaagtctctgtctctgcttaggaatcatactaaggctcctaacaataacaaaatcagcaataatacaaataattatttatataaacttttcaaacaaaatgattcttctcacgccaaaaaatctaataataaaacagactaaattaggtatggatttcacaccttacattattaaagtattaactatattttgcaacaaaataaatacggttcttatatacatagtgggtcatatttagcaattttatatggtagtggttttgttcttaagttttatgcaatataatggtacattccaagaatttatctgacattttgggaaagtctaatatttctattcacccattaatccggacgaacttttagggtgagttactcctctcctaagttaagcatattcaaaaaatcagaaggtgcatagaccggcactgaagactttgtataatccttcaaattccgtgtaacaatgcagtccatatcacatcggagtgcagattctaccataaccgcatcttcaaaatcagaaatatccgaagaaatggcacgcctgcagtccataccagcagtatcaagtaaatcaaacagaccgaataacgtatttaaaatagttcttgtgtctttgtcattatgagtatacctatgtgtaagataataaatatctgttgctgattttgcagtgataaacccggaaaaccgcttattagccgtagcgagaaaaatttcctgggcttcagcacagaacggctgcctgctttggagcgcatctacaataatacaggtatcaatcaacgctctcatagtttatttaacctttccttttttgattcttccaaagtgatatcggctggaaggacaccaaacagagactttgccatgtccacccgatcctgatacggattggtaagtttggctacaacttttccattccgggtaatataaatatcttccttttcagcaagcatcagatacttactcaggttcatttttaactcagttgcagtaattgacattacgaatgcctcctttcctttatatagatgtattcactattattatactcaattcgtacgattttatcaatgtattcgtacgatttttataatctgtttatatattggaaaataaatgaatacggttctcttctgtcactgtattcattatatacatccggaactgtcgccttcgacctacagttcgaaaaaatactatcagctaaaaaattcaataaaaaatttaaagtataacattcttaaacacataataaggccagaattttcggaataggtattcagaccttatttaattgtcaaagtgtccaaaacaagactatattccctataaaaggtaatgattgtaaaccaaaaataaaccggctgagttatccggataatatccgaaatccagtcggtttattttaaactatttttttaatttcaatggccccaaaagaccagagggcggcaaaggaaagtaccgggataaactgtcacgttctttgtagcccaggttatttaccacttcaatcctaagtttattccagccttcaattaatatttcatcgatgaaaaaaaagtaaggaggcactattttggctccgcaatagatatcatttacccatatttcaacaacttctcctaccctgcccaaatcaatacaccggtaatcggacgcatttgtcagccaaaaagaagcctcatatcttattcttccactgaattcaggaagcaattccggatttgataagttcactaaccccattttcccattataaaggctaaatctggtattatcccacaaacttacctggtatttcaaatcaagctgtaaaccttctgttttgtctgaaaaaaagccatcgcttttttccagcaatccagattcataatcgccggaaagaaaaattttcaattccccggggaacagatgaagatacagtaatccatttgcaaattctgcataatacagtttattatcccatgggtcataaaaaacccccttctcttcctgtattctcacgtctccgctccattccctgtttctatcctcgttcagaaaaacaaaaacatgtgtattctttcttctgtaatgatagatccgcaataatgtatcgctgatcggtccggacaacaatttcattatgccagccgaatatagcgtttttatcagttcttcataggaaatactataacgccttccttccggtttcttgtatatgtcaggtactctccctacaaaataaaccgtcgccccatcttctgccagacagtttatcttgtccaaaagtttttccggcagatattcacagccaggaacaagaagaacacggtatgtttcctgataaacacggattcccccatcacagcatatggctccgtataattcatcctcaggcaaaatatcaaaatccacctgattccaggcaagtttacctgtcagtttttccaaaggaagatattctcctcccgcccactcggcttccgcatgataaaggatagctacaggtgcctgatggataccatcagacagaagatgacagcatcttcgcatataggaaatcagccggccaaataaaggaaattgcggttggttgcctcttgcaaaaaaatgaggaggacaatccggatctggatatttaggtgaaaaagcatgaggaacaaaataattgataccacttaccagcatctcgtctgcaatctgtttcatcatgggcagtccctctgcccagccgaacgccccaaaaatttcgcacattgccctccctttctttcttttgttgaaatgtgcatgagatgcagccaacttaggcagcgtataggtaaaaaacaggggatccaccatatcttctatgaccggcgcagcataaggtatcttatgaatacccggatatatctgtcccaatacaatatccatcccagccatatcctgtccgtccaacccccggaaataatgagcagcgccatatcccaggcgcatatgggcgttcatatcctcaattaaatgtcccactgacataacaccgtgctctctgcaccaatttccaagcaaatctgaaaagttatgtctcattcttttagatacgatatccatatatgccattctaatccaaggcgtcttttctcctatatcctgccacaaagccggaagcagccctcttatggaaactgtctccatatccagtctgctgcccaaaagcggcagcagatcgtcattccatggtataagcatatttgcttttcccaactttgaataatatgtttgatcatcatttccgaaaccgggttcatcgaagaaaaatcccgcaaagacgtttccgaaatattttttaaaacgtacataatgaggttcatagatgctctcaatcatagccttacatgattcttctgaaagcaaatcaatatagtcttccttcccgggaaccgtatcataagtccgtattacaaaaaaaactctccatattccgggtggaacatcaaaatataccaaccccctgttaaaagactgaagtaaatctatctgctgggtgaaaaaaacttctgcttcctccttcctcctccatgccgaaatggaaacataactttctcctgccttcagtcggtttgcaagaagcgcgcacccttccaaaggccccggtacgtccatatattccagcctgagtgaaacctttttaagctccggatgtttatgaatccatccgtttgcatagccggtaggaaacttcttatcatccaaaagccatactctcatatttcttttcccggcttctttcaaaatgaattccatatccgtccaccaattagtctcacagaacttttcatgtacccggctttccacacagaactctttgatcccgcttctctgtatagcttcgatttcttccaacagaatttcatgagtttccccatgctgccaaaaaaagggaaagatatatttaccaggctcctgtccattcaggcaatcctccagatatttgtccatgctttccaccatatccctctatcatttttggaaaaaaataatttctgcacttcccctcgaatgtctgccaatcagggatacctgaaccattagttctgccttttccccatcatagttttccaaatccagttcaaactctttttccgctttactaccccataaattattaagaggaagccgtacacaggaagctcctttacaagaaatatcccgcggcaggtatagtctgatggaaacccactgttgttcgtgcatttccattccgttaaccacagtaacccggaacctgcgttttttccctttctcgaaataaggttcttccaaatagtctatggccatccagaaagcagggaaatcatatcttaccacaaaaggagaaagcagacacagttccttgacattcagcctttgatcctttcctcctccattcgtattttccatataagtttcacaggaatccgcacgtaattccatcccttttttacaataaatagtataatcaccgtcctgctccattttgcaatatgcggatcccaggaatgccggcatctgtgccgccacccggtgagtcagctccgttaccgtatccggtatccagattcctccttctgttttgtttatacacaaagtaacgattttatcattaataggttccagccatttatccggaataccgtctataccagaaagaatccccagcagcgcccccaaagttgctgctgtgcaatccgtatcctctccgcaattgacagcaaggcacagtgattttccgaaatcgccttccccatacaaccatcctaaaatcataaagcctatattttccggtgcatcaaacccaggttcccctatatcaagttcctcctcccggacaagcctctcaatctccgaattagtcagattctggattccaaaagtacccggagccgtctggtgcacacattttctggcttcatcaaacggaagcttttcttcataacagctgcacgctgctttcacacaccgggcaactgcacacccttcaggtatataagaaaggccaatggaaatcaaatcaggaatctcctcttctgcgaacgccgcactctgcacggcagcgcaaaacacctccccatatacgccttctcctgcatgatccacaatcccatcttcataagcatatctcgccgcaatatccggatgtcccggggcaaggcatgcccaaatctccgaacggataaagcagccgcatgaattacgatatgcattattcatatagccgctcattggcggaaggactccattacgcagatttgccttccccatcccatattctacccagttaggaatcacataggagagccagtactctccgagaatcatagcatttacattcctgccatacctttccgcagctgccagccagataatctgcagatccaaatcatcattcggaggaggtcccatacttagatcctgggtataaaattccacccggttcatctgtctttttccctcaaagggcgctcccaacactccacctgcatttttcccggcccaacagccggccacttttctcttgtaatcattaaaattcattttcgtctccccttttcataaatgatttattgctttattgccccacttaccactccctgttcaaaatatttctgcagagaaatataaataattatagtgggaatcataattataaataatgctgcaaaaagattatcatatctttgggaatatgcgctcataaaatactgcggaagcagcgttactgtttttttggatgagtcggagaaaaacagcataggccacatataatcgttccacgcccccaggaaactccaaagaacaatcacaaataataccggtttggccaccggaacaagaatactatgcagaattcggaatgaacctgccccgtctattctggcagcttccatcaattcattcggtatatcgtcaaagtagttcttagccatgagcagattaaacggaattccataagcaacctccgtcagtatcactgcaaaaatactgtttatcagtcctaaatccctaataatcataaagcaaggatacataaccgtagccggaggaatcattaacgcgctcagcagcatcagatagataaaaccctgtcctttaaaatgatatttagacaggccataggatgctaaaactactactcctacattcataggaactgacagaataactatcaaaatactgttgataaatgccggcaggatctgttccgtatggacaacttccctgtagctgctaaaataattaaactccgtaaatgcggaatctaaaaacagggaacgcagaatacccaacgcaataggggttataccgattatgcagcatcctgccagaaataatgtgccaataattcttgcacttacaacctttttcatgttgcttccttttacctttctcaaattatgtttataattctctgcctttgttatacattttcagttgcagcgcggtcagtatcagcgatattcccatcataatggtagcaacagctgaggctcctcccatgtcatataacttaaaagctttgttataaacgtatatcgtaaaggtaaccgtagtatttcccgggccgccgttcgtcattacccaaaccaaatcgaatagtttaatataggtaattacattcataataaccagcgtatatgtcgttccccgaagcataggtattgtaatatagaaaaattttttcaattcccctgccccatcgatttctgcggcttcatacacagtggaaggaattcccgaaatgcctgcagtatataatatcattgcaaagccaacgccctgccaaagcaaaatcatcagaatcacatacaataccaatttaggattaataagccactgctgtgccagtccattcagaccaattctacgaagcagtacattcacaattccgttattggcttccagcagagtccggaatgtatagccgataataacaggcgacaatacaacaggcagataaatcagcacttttgctatttttgatattttcagttccattttcacaaacactgcaattatcattccgaaaatacagtcaaatatcacaaataagcctgtaataaatacaaagttcttaagtaccgttttgaatgccggatctccaaaaactttttgatagtttttcaatccggtccatattggctctccaagcccggaccatttatgaaatcctataaatatattaaaaaccaccggatatgcaataaatataaaaaaaataattaccgcaggcagcacatatacatatcctaacctttgtttcctccgcattttctatcccctttcgataaaaatggcagggtaaatcccctcgtgaatttgccctgccaccttaacagactccttactgctcatctgctactgcctgaacccgtgccgcgccatcttcaggagataacgctcccattgcaatttcctgaagcactgtaagaagctccgctttcgtctccacattggtcagttcacgcacgcctctgctgtattggaccatatcctttaagctttcctccatctttggaccgctttccccataaaaggcagtgctcaactcaattccttttcttgccgtctgcatcacatattccgtctttgaaaattctgtcatatattcggatgcaaaaaacatggcgaacttataagccatttcttttgttttctcatctcccgctcccttattcacacagatcatatcagacagtgctacctgtactgcaggttccttgccctgaggtgcaggaagcggcattactgcccactgataatcttcttcaaatttaggactcttttccgcgtttacgtattcccccatattccaatggccgttaaataaaaatgcggcattccctgcttcaaacatatccagggcatcattatatatactaaggcccaaggcaccgtcaacaaaaatttcatctgtaaaatacttctgccactgctttaatgcttccaccatttccggatcagtccattttccgttaccgcgttccacctcatatacttttcctggtgcaaactggttaaataatgtcacaataaaatcctggtttgcccaatcgtccttggctcccatggcaataggcataatgcccttctgccttaaaaccttactgcactctgccagttcttcataggtcgttggtatttccaaaccattctcatccagaagggtttgatttatatacagggaaccagccacgcttaagtaagtgggagctcccagccatccaatcccttccgtttcaatctgcggccatatcacctcttcaaactgatccctccagttgtctccgagatccttttccagataagaatccaatggctccacataatctttgaattgctccaacagcgctcccggctgaagtttaaatacctccggtccttcgccagccgccatagtcaccttcagcttatttacataatcatcataaacatgaccgcagttatcaattacgatatccacattcggatatagttcttcgaatctcttttctgcatctgacagtaccttttcatctccccattccatataggtaatcgtaattttttcatcggatgccggctcttcggtttttacctctgaagactctgccgcccctgcactgctttccttcaaagccgtatcctctgctgcctggcctgcatccggactcccacagccgaccgaagtcaccagcattgccataaccattaataataccattccttttctcataaaaccttctcccttccttgaattgatgcctttatcttaaatgttttatccggagaagtaattatactgtgtttagattccatggcacaattttatgattctttccgggtaatgcagccttctttatatttcgccggtgtaacgccggtaatattcttaaataatcggttaaaataatgctgatcaggtattcctacccttgatgcgatttcatacattcttaaatcggtattcctgagaagcttttgggcttccttaatacggtagtgaattaaatagtccgtaaaactcatccccgtttctgccttgaacatctgactgaagtaaacccgacttaaattgacatgccgggaaatctcctccaaagtaatatttccttcataatgttgcctgatatacctgatagcactgtttacctcttctctttcataagtttctctttgatgcctgtctaaatattcttctatccaccgggcgctgttcacaagcttttccctgcattccgaataagttgccgagccagtatgaaggtcatatcccgtgtctgttttttctccatagtttttttccagtctacccaagatcgaaagaagcactgccaaaatatagtcttccacctttcggaataattgaggatgaagtcgctcctctctggcatgttccaagagtcgttccataattttgctgatttcctgcccatgtttaagcatttcataaaatccgctggcttccgtataaatataatccgaatcctgtgaaaaaacagttccagtacaaagatatacattaccatatcctttgtaaaacatattttccaaagcaagttctgcctgctccacagctttttttgtatttttcaagtcacattgcgccttactcatgcctgctgccgcctgaatacccagatactcatcaagcttttccagcgctttattcagcgtattatacccctttttctctgtagacaattccctttccaggccatcacatgcaaaaaaaactttatagttaaggctattttccacacaaactataccatgcccttctgtctgcattatttcttcaataatatttgaaactgaaaattcaagcaattctatgtcatatctgccttcttcaattaaaaaggcgccaatcctgtcattcataagtctgatatttccaaacaggaaagttatttcctgactggaaatcccaaattgctccaaatcgttcccagtttcctgtatggcattttcctcattcaccgccaatttttggaatatccggcgttttatggcattcagatttctttgcagacgcctcttcataagctggttttcttttcttacttcttccacactgttaccagaaacatcttcatggatctcattaagggtctttagtattttgtcttctgacagctgatgcttcaacacgtaatctacagcgccaaatttcatggcatcccgaacgtattcaaaatcatcataaaagctcagcactactaccttagttggatatcccgcttctttcattttacttatcagttcaaccccgttcattctgggcatctggatatcggtaatcataatatccgggcattcctgttccaaaagcgcaagagctttaatcccattgtcggcttctcctattacatgatatccgttttcttcccagggaattgcatttttcaggtattcccggacagaaaaatcgtcttctactattaaaactgtcttcatttcttccccttcaaatgtatacattttctatttcttcctcaattgctgcaaaatgcagggctatctttgtattgccgttttccctgcaaatacgcacgccatatctttccccgaaatgcagttgtatccttctgttaatattcttcaaaccaatatgctcttcccaatcctccgcttctccagacaggctttcctttacttcctcaagcctttcctccgacattcccactccattatccgtaatccatatccaaatgtcctcttctattttttccactgacacctgtatctgcaaaaggctactgcccattccatgcaggatgcaattctctaccacaggctgtaagatcagtttcaaggaacgatatctcccgacatcctctgggacgtaaacagcgtagacaaatttatttctgtatcggaatttctgcaaaatcagataatcttccaataatcctatctcttctttcaccgtaatatattcttttttataatccagacttttcttaagcaggcttatcaggctttctatcagcttcgcatattccttttcgccatgaagcagagcatcgcacatcaaagaattcaggatattatacaaaaaatgaggggatatctgactctgaagattatgaagctccgcctcattttttttacgctgctctgcctcaaattcacaaaacaactcattaattttctgaatcatcaggttaaagccttcacaaagccggcctacctcatcccccgaaaccacagtcactgttcttgaaaaatcacccttttttacggcatccattgatctttccagttgttcgatgggccgtgttatcccctgagagatctctatcgccaaaaaactgacacaaatagccaacaaaacaaaaattatcagaaccaccacaaaaatcatatcggtagaatggaaaatttcatcatatggaacaatatgtactatccaccatccattcagcagtttagaataattcaatatatatttctttccctctatctttttaataattcttccattatcactctccatcgcaatattttcctggtaaaccttatccatcacttcgtttgtaacaaatttttcgtcccccacaattacatttccatcactgcccaccagttgaatctcagcatttcccagataattgaagtcatgcagcatttcattcagaaagctttgtcccgtaatgtccacataaatagttccaagctgctttcctgtaccaaattcataaatctttcttcggtagacaatagaaaccatatctttattctgataagagtctataatatagaaccacttttgatatttattgtttggaagtttaatatcttcatattcctgtctgctcagagcccggctggcagaacggttataaccaaaggaatagccctcacctccattttccgattggatttctatactgttaatatatctggccgctccaagaataggcttcatataattttcttccagtttttttctgtcatggtacaacgttactgaatccgtctcttccttctgtaaaaaggaagtcaccgcgggcatggatataatctggatcacgctttcctcaatattttccagtagttggttcatactcacggacatcagataaactgtattatcagaggcctgaataacctgttctttcatattgctgcggaaaaagactgtagacagcacagtggcaatacataagggaaccactgcaataattgtcagtataaaaagcagacgctttcgaagactcatattactcaaaaaaacggccgctccatgctgtagttttatagcctggtattctatttttacccataattgcttcataaacatcccccctagaaatcttaccatcattatacctgattccatttcaaatatcaatgaaaggcaataaaggggcagtatccaaaaaatggatttgccccttcctgtctttatttcaactatacctgtcgtttttacctgtcagcctaaagaagcccttgatattccatcgtacacaatacctgtataaatctgccccaatacaatatccataccagccatatcctgtccttccagcccacggaaataatgagcggctccatatcacaaatgtatatgagcatacatatcctcaattaaatgtcactctgacatatccccgtgctctctgcgccaatttccaagcaattatgaaaaattatgcctcactcttttagatacgatatccatagatgccattctaatccagggcgtcttttctcctatatcctgccacaaagccggaaaaagccctcttatggatgctatttccatatccagtctgctgatcagaagcggagcaaatcgtcattccatagtataagcatatttgcttttcccaacttggaataataaatttgatcatcgtttccgaaactggggtcatcaaagtgttgccagtactgtttgttcctaccttgcatggttaagtgatatcggtaaaccaaatatttgttttaaagacaatctattactttggggataagtgtaaaatgaattatttatcaaaataagtaacttatatctgcagagtaattttacatctgccaataaatattcattcaaggttaaccgtttacaaaacaatatctttcataaaatatataacagcctccaactcagtcttcgataattttcgatttcatttagcagcgtaaatttttgccgttctttatactttgcagatgcattttctttaattatgaacaataatatttgatacattttgtttgacatataaatccaactatttaaatgttcatccccatttttgagtaagtaatattgattcatataaaggattcttttctgctgcattattttttgagagtacatgacataaaaggaatgccttaaacccagcggcattactttttcttcccaattttttcaaattacattaactgataacattacattccaaaatagtgtttttcttcctcatataagcttaaataaggggcttgggtaaaccaattacgagtaaccgtacctttaatataatcctcaaaagaattttttacgtgcatagaaaaaaattaaatctattttcaacatcatacttatttaattatataattacaccatgtagtaccataaccataaattaagggatcatggaaagtagcatcgttatatttgcttatttgagaagtgtctaactgaaaagtcaggtaatatccattatctattacgtctattataaagttcaaaatagaagaattcttaagaatgatccttttatctattatattactaagtaaaaaaagacaattctccatattaatatcaaagtaatcaatgtttatctcatattgatatcccgaatacaattaataatttaggattgctattaggctgtattgtgctcagtacattgataatccctttaatccgtttggcaggtaattattttctgtttgttgattctttaaaacatgatagatatatgtttaacaaattgtgtattatacgcataaattccagcgcaatgtgatggcctgtccaaaacgtcgggtgtcatacaagtcttctttcataatgcgcataattatatcatccctatctcattctacatttctccctttgcggcaagaacgtgtgtaatagcctctcgtgtacctttatatctgcaattatttatgaggtaccattgtccatccatgaaaataaaatttaatcgaagagaactttaggacatttctgcaacatttcagctttagaataaaatttataacattgtttccggaggaagtgagctcatgagaaagatactgattgtggaggatgataccctcctgaataagacgctggcttacaatctgacatcggagggctacgaaacggtatcggcctttacctacgcctcagccgtggcacatctgcaaaagaatgaatttgacttggtgctgctggacatcaacctgcctgacggcagcggactggacttgtgtgaagaaatccgggccaggggccagaacagctacatcatgttcctgactgccaatgacaaggaaagtgatatactgggaggctatgaagcaggcggtgcagactatatcacaaagcccttttccatcgccgtgctgtgcagaaaactctccgccgtctttatcaacatggagcggcggaatccccggcacgacctgtacgatgacggcgtcctgaaaatcgacttctccgagcagacggcattattgtccggagagcctctggacttcacgccaaaggaataccgcaccctgttcctgttcgtcaagaacccgcgcatgatcttgacgaagcggcagctattagaaaggctatgggacatcgacggcgactttgtggatgagcataccctgacaaccatcataagccgcatccgaaagaaaattgaaaccgacgagcataaatatatcaaaacagcctatggcatgggctatcagtggacggggggtgagccgaaataaaaatgcaaaatatttcaatccgcaagtttttaaggataatttgcgcgggtaccgccctgactgccgctgctgtgttggcggtgctgtattggctgacacgggatcgccggattgtgctctgtgggctgattctaacagccgtcctctttatgtggggtgctgtttttttgaaatactttcagctcaagttgtcccttttcaccgacagtctgtgccagacattggatggaatgatgggcggcaatgagcggcctcatgtcgattatgaggcggaaaccctgctggcccgtatcagccaccggctggaacggctttataacaccatgcaggagaatcggcacaaggcggaggaggaaaaggccgagctgcagtcgctggtatctgatatttctcaccagacgaaaattcccatcgccaacttaaaaatgctcaacgataccctgctgacccgccccgtgaccgaggaaaagcgccgggaattcttggaggccacggggagccagctggacaagctggactttctcatccgggcgatggtaaaaacctcacgtttggaaaccggtttgatcgtgctggaaaaaaagcccgcggccattgccgatacactggctgccgccgtcaacggtgttttggccccaatggagaaaaagcagatcaccctatccgtggactacccggaggatttgacggtttctcacgacagtcgctggacttccgaagccctgttcaatcttctggacaatgcggtaaaatatactcctgcggacggaaacatctatgtcacggtagaagtttgggagttttatgtaaaaattgatgtggccgacaccggccggggtatcccggagagtgcccaggccatcatcttcaagcggttttaccgggaggagtccatgcataacgtggacggcatcggcatcggcctgtacctcgcccgtgagatcatcaccatgcagggcggctacatcaaggtcgtttcagagattggcaaaggctccacattctcggtgttcctgccatggagataataaggcggtggtctgcccgcgcaggtcatcgctatctttttcgagaaaaatttaaaagaaattgattttaggatatttctgcaacaattcagttttacgatatgcctatcaaacaaagaaagacaggtattccaatgagtattttacagacaacagccctaaaaaaatactacggcaccgagccgaacatcactcgtgccctcgacggcgtaaccctttccgtggagcagggcgagtttgtggccgtagtcggaacctccggttccggcaagtccacgcttcttcacatgatgggtggactggacacgcccacctccggttccatcatggtacgggaaaaggagctggcgaagatgaatgacgagcagctcaccattttccgccgccgcaacatcggtttcatcttccagaactataaccttgtaccgatccttaacgtctacgaaaacatcgtccttccggtggagctggatggcgatacggcagaccaaaaattcatggatgaaatcattcagatgctgggactgaaggacaagctgaaaaatatgcccaacaacctctccggcggtcagcagcagcgtgtagccattgcccgcgctctggtgacaaagcccgccatcgttctggcggatgaacctaccggtaatctggacagtaagaccagtgccgatgtgctgggccttttaaaatgcaccagtaacgaatttaaccagactatcgtgatgattacccacaacaatgagattgcccagcttgccgaccgcatcgtgcggattgaagacggcaaaatcatggtgtaaggaggagacatgatgacattaccctttgacaatgatacaagccgcattgtaaaaaagctagtaaaaagaagtttagcggctgaaaagcgccgcaatttgctcatttgctgcaccatcacctttgcggttgccctgatgactggactgggtttttttgctgctgcacagaaagcgaaagtagagcgggacatccgcgggcagtatcaagtcatgatactgaagtctactcaggagcgggtcgacagtctgaccgcaaaaccggaagtggagcgctggggcctgtcaagtaccttcccgatctcccgttatcaggacagcgttctcagcgtactctatgcagataccaactggatggctttggggaacaagcccgcagttgaggggcaaatgccacaaggtgaacatgagattctggtggaaagtgcttttttagattacttccatctgccgtatgaaaccgggcagcagatcaaactcgaccttggatgcggggaacagacctatatggtaacgggcattcttcaaactgagaatctctcccgtatgtttgaggttattgtttcaaaagcctttgtaacagcgtattccgatggaacacctgaatttgagtttcgtatgtgctatcggggaggggagcagatggacacagaccatttgaaggaggctatcctcacgtttcttgcagcacatgaagttccggagcaagagattttcttcagctccaattattttaacatggagggtttccgcaataatgcgggcgggtatgccctgcctgctgccttcgtgatcctgttggcctgtggtatcgtgatttacaacattttctatatctcggtcaagggtaaggtgaaagaatatggccgtttaaaggtcattggcgccacacctcgacagctcaggcggatcgtccgctatgaaagcttgtacctctttctccttggaataccgaccggccttgtgatcggcggcgtaatcgcttttgcttgtctgcccgcctactggagttgggcagataattctaaggctgcggttgtcatcctcgccatgactgggatgatgatatttctgtctaccgctactccggttcggatggctgcaaaggtatctccaattgaggcgatgcgcacatcaacctatgccagggaaggaaggcacgtgaactcacgtcggcctcaccgtaggctcacaccgtctgtcctctctaagataaattttgaacgcagcggaaaaaaggcagcaattacgctggcctccctcagcttgagcggaattctgctgctcacggcagcgacgctctatcactccatcaactttaacagtatggcggcaaagtacatgggggatgaggggaattatatgatttcctggcaggatgccgtagacatggagaagattccggagcaggcgttggacaacccactctatgacgatctgcgtgagcagattttggcattgccggatgtggttacgattacctcttatgatgctgtcacagtggagattgatttgccgagaaaggcggacaccttcattataaccgctatgaggagggatcaattcagccagcagcttccggaaaatcggattgccgcaggaactgcagactacgacgcattgatagagggcaatggtattctaatttcggacagcagtgaccgtatcctgtccggctatgactatacgccccaaataggcgatgtgctccatctgaaaacttacggcggacaggatatggatttgaatgtcatgggaattgtgaaggaaggaagccgggatgccactggcgtgttggcatcactctttattcttcccgaggagacactccacaaactatacccagaggtcgaaaatttccagatggtctggaatgtccatgccgctcaagacagtgatgtactgcgtatgcaactattccagattacgaaaaatccggcgctgaccatcattgcccgtagtgatctgacggctacccttcaaacctcttttcgggaattggtaaggctggtctatctctttacagcattcctttttgtcttcgcactgatcaatttgacaaatacgttaataaccaacctgttgacccgcagacaggaattagggattttacaatcggtgggtatgacccgcaagcagctttccagaatgctttcgtgggaatgccttcggtatatatctggagtattgggggcaacagtcatacttgggagcgcatgcggcgcagtacttattctgatcctgaatcgcctaaacgtattaggcgttccaagttattgttttccgatgtgggagctgacggccttcgtctgcgcacttttaatcattcattgcctatatatattatttgcaatacgttatatgaaacagcaatctattgtagcatgcatcagggaggcaggctaaactgaatccacagtccggatggctttgatgcctcgaattattgtcggttctggaggctatattcaaacagtatggacataaggagacgaaactatgactttaccatttgaaaatgacaccagccgtatcattcgcagaattacttctgcacatctggaacacgacaaactaaaaacggttattactatttttgccatcactttgacaacatctctaatgtcatccatattacttctgatttcaggaattcttctccgtaatacaaaaagccatcaggagataaaaactatagcagaaatattaggtgacaattttaaatttgtggtaaaaacttatttacatacgaatgaagaaattagtaaaatgaatacgaaaatggagcgtaggcaagggtctaaatgtttcaaagccattcttaagtaaataaaaaaacctcgaaaattaaatgtttttcgaggtttttaaagaggcgcagaccggatttgaaccggtggatactggtgttgcagaccattgccttaccacttggctactgcgccttatttattatattatatgcagaacacaatctaaaaatgactccgacgggaatcgaacccgtgttaccgccgtgaaagggcgatgtcttaaccgcttgaccacggagcctcttttcttttccaggttccttcccctggctccacgctttctccagcgcttttacgctcctcaggactctgccttcacagctcactccccgagtagggctcgaacctacaacaactcggttaacagccgagtgctctaccattgagctatcgaggattacttcttaccacttctctttaacttactttaggaacccataccctcaaaaccgaacattgaatttaatctctttctccaaaacctgcttcccataccttcaggataagccctcgaccgattagtactggtcagctccatgcattactgcacttccacctccagcctatctacctcatactctctaaggggtcttactacttgggatatctcatcttgaggggggcttcacgcttagatgccttcagcgtttatccctgccggacttggctactctgccatggctttggtagccaacagatccaccagcggtccgtccatcccggtcctctcgtactaaggacagctcctctcaaatatcctccgcctgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagtcctactttcgtacctgctccacccgtcggtgtcacagtcaagctcccttatgcctttgcactcttcggatggtttccaaccatcctgagggaacctttgagcgcctccgataccctttcggaggcgaccgccccagtcaaactccccgccagacattgtcccccgcccgggtcacgggcgcaggttagaaacccaatgctgcaagagtggtatcccaacagtgactccatgattactggcgtaatcacttctcagtctcccacctatcctgtacatacagcatcgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcggagcttcgttgcctgactcctcctcttaaccttccagcaccgggcaggcgtcagcccatatacctcacctttcggtttcgcatagacctgtgtttttgctaaacagttgcttgagcctattctctgcggcctcctttcagaggcaccccttctcccgaagttacggggtcattttgccgagttccttaacaatgcttctcccgccggccttaggattctctcctcatccacctgtgtcggtttacggtacgggtatcatatgaacaatagcggcttttctcgacagctggctcacctgcttccctacttcagttcggtacgcatcacgccttcggattgctggacggatttgccagtccagctcctacttcgcttgcaccgggtttccctttcccggctcaggctttccctctgtgtccccacagttctgtcatatgatagtacaggaatctcaacctgttgtccatcggctacgtctttcgacctcgccttaggccccgacttacccagggcagatcagctttaccctggaaaccttagatattcggcctggaggattcccacctccatctcgctactcattccggcattctctcttcttaccagtccacaataccttacaatactgcttcctcccggtaagaatgctcctctaccaacgtgaaaggaactaaagttcctaacacattcctaagcttcggtgccgtgtttcagccccggacattttcggcgcaggacctctcgactagtgagctattacgcactctttgaatgtatggctgcttctaagccaacatcctagttgtctctgaaatcccacatccttttccacttaacacgtactttgggaccttagctgtaggtctgggctctttcccttttgactgcccaacttatctcgtgcagtctgactcccgtacagcattcctatggcattcggagtttgatattcttcggtagactttgacgccccctaggaaattcagtgctctacctccatggaacttatacgaggctagccctaaagctatttcgaggagaaccagctatctccgggttcgattggaatttctcccctatccacacctcatcgccacccttttcaacggatgtgcgttcggtcctccattgccttttacggcaacttcaacctggacatggatagatcacccggtttcgggtctgcagatactgacttattcgcgctgttaacactcggtttcccttcggctccgtccctgaaggacttaaccttgccagcacccacaactcgccggaccgttctacaaaaagtacgcggttgtactctacagtacttccacagcttgtaaacacaaggtttcaggttctctttcactcccctcccggggtccttttcacctttccttcacagtactatgcgctatcggtcactaaggagtatttagccttacggggtggtccccgcttattcccacaaggtttctcgtgtctcgtggtactctggatcctgctgtccaaacttggttttcgcttacggggctttcaccctctctggccggtctttccaggaccgttctgctaaccgcatctgtaacgtatgcagtccgaaccccagcatgcacgcacgctggtttgggctcttccgttttcgctcgccgctactcacagaatcgataaattttctttctcttcctccggctacttagatgtttcagttcaccgggttccccccgtatccctatggattcagaatacggtgacggaggtttgctccgccgggtttccccattcagacatctgcgggtcaaaggatatttgctcctcaccgcagcttttcgcagcttatcacgtctttcatcggctcttagtgccaaggcatccaccttgtgctctttacagcttaacctgtttgtaactcgtccttacttggtctcgttacggcatacatagcgttgtatgctctttttggtatttcttcccattctttcgaatggatcattgcttgttttggatgtcttctcgtttatcttcttctatccggttggtttctttcgaaaccttccttttagacgttgatactttaagattattttcaatattcggttttcaaggtacggattcttttcttgggatgtttccatccagtggagacggagagattcgaactcttgaccccctgcttgcaaggcaggtgctctcccaactgagctacgcccccattcctgacggttcactcgtttggttattcagaaaggcactctttcaagttctcttccaggtcttttctccgccagtgggcttaagtggactcgaaccaccgacctcacgcttatcaggcgtgcgctctaaccggctgagctataagccctcattgtccggtccggattgctttcgctttcctttccttctatatgagtatttaattgtttttgttgtaatccggcagccacctgctctcccataccgtttccagcatagtaccatcggccgcttaagtcttaaccatcgtgttcgggatgagaacgggtgtctcccctaagcgtatcgccaccggaatcttcgcgatgcatgagtaaatgcagggaacttaagttcccttagcctattaatgagagtgttggaagcttgcttccataagctcttattgatgaggctgcataagcggcgaagccacgaccgagaagctttcgcttcgagggcacttacggacttccgcttactcctcaacatctaaacagtaatacaacccctacttcttcgccttagaaaggaggtgatccagccgcaccttccgatacggctaccttgttacgacttcaccccagttatcagacctgccttcggctgctcctccctttcggttaggtcacagacttcgggcatttccaactcccatggtgtgacgggcggtgtgtacaagacccgggaacgtattcaccgcgacatgctgattcgcgattactagcgattccagcttcatgtagtcgagttgcagactacaatccgaactgagacgttatttctgggatttgctccacatcactgtctcgcttccctttgtttacgccattgtagcacgtgtgtagcccaaatcataaggggcatgatgatttgacgtcatccccgccttcctccgggttatccccggcagtctccttagagtgcccagccttacctgctggctactaagaataagggttgcgctcgttgcgggacttaacccaacatctcacgacacgagctgacgacaaccatgcaccacctgtctcccctgtcccgaaggcctatctcttttacaagatattcagggggatgtcaagacttggtaaggttcttcgcgttgcttcgaattaaaccacatgctccaccgcttgtgcgggtccccgtcaattcctttgagtttcattcttgcgaacgtactccccaggtggattgcttattgcgttagctgcggcaccgatgggtccatacccacctacacctagcaatcatcgtttaccgcgtggactaccagggtatctaatcctgtttgctccccacgctttcgagcctcaacgtcagttacagtccagtaagccgccttcgccactggtgttcctcctaatatctacgcatttcaccgctacactaggaattccgcttacctctcctgcactccagcctgacagttccaaatgcaatcccaaggttgagccctgggttttcacatctggcttgccatgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcaccctctcaggccggctactgatcgtcgctttggtaggccgttaccctgccaactggctaatcagacgcgggaccatcctgtaccaccggagtttttcacactgcttcatgtgaagctgtgcgcttatgcggtattagcacctatttctaagtgttatcccccggtacagggcaggtttcccacgcgttactcacccgtccgccactaagttatactgattccatccgaaaacttcctcgatataacttcgttcgacttgcatgtgttaggcacgccgccagcgttcatcctgagccaggatcaaactctcttgtttaagtgtttaatccggttaagattaactctagctaatgtttaaccgtttgtttgtttccaaacatttcttactgtttttgggtgtcttaaaggtcttctttcgaagctttaaaacttgttctctgaattttcttttttagaattttcagggttgcattactgtttatttgtcaaggttctgtgtgctgctttctcagccgcaacagttgatatcttatcacatgttgttctgtcagtcaagcactttttttaactttttttatttctttcaagctgttgtttcaccgttgttcgcggtgagtcttattttagcattatgtatcgttagatgtcaacattttttttgaattttttaacaactttttggaatattttattaaccccaatatcttgtgtttttcagtacaagatattgtgttaacagaggctttattccgaggctccgctctcttttttcctccaggcgggcgaaggccggattcaggtataaaataaaaaggggccggatatctatagaaaaggagatatccagcccgaaatataattggagttatacagacggagcagccattcattttcattggtccacttcataatctgttcaccgaaggagcctgtagggaagttttgtataataatgtagagaatccataaagcgaccgccacctccaaaactcctgctgcgattcccaaaatgctgttgaagaaactgatgatgggaagcttggccaccgttttcagggagttgagtacaatgctcaggagatggaaaacaatccctgttattataataaggataacagccactatcccgttcttattgttatgatccataaagctggaaatggccataatggaaagcgccaatacgaagagggcgaccaccagggaaataagccggtatatttcttctgccatccctacgcggaatcctctgtaggctctccacagacatagggcaagagcaatgatcagcagaatattaatattcatttgcatatgcatactcctatttcatttctatgatatcaatactgtctttggaaacggtcaggtattttttcgtgctgaggggtgaaaataaaagaacaggcttttcaaattcaccgcggaaccgttccagacctttcatattaaatatcgtacattgagtttcattatatataatgactatgtccttgtacaggatgatatccttataatccatatcaaagtacagggaggtgactacggtaccggaggtattatagatatccagacgatattttcctgcaccggttgtgtcgagaaataccagtccgatgttattatcattgtaaaaaatactctgtatttcttcttccagagaaacatccgccgtgcttttcggtctctggtctccgctgtaaatgacaaggcggttatccgctacggcaaaagcagtatcgccgtttatgaatgtgagatagggaatgacagcatccacgtagtctgctccgctggcaaaattatctacaaagttctggccgaccgagctgaaattataaaacgcaacactgcttttggcagcgccgctttccactgtaatataggataccgccatcagctttccgtccggggaaagggaaaccgctgccggatagccgcttttctgcatggttgtctttatatatgccactttttcacctgcggaattatagagataaatccaggtgatattagtatcttccaatatggccgccaccataccattttcggccaatgcaaattggcggattggcagattggtatctatctccacagcatcccctgataatgctatgttatgtatgatgtgtccgttataatctgcaacggcgactctggtcctggctatgcgcaccataggatcctgcatttcaaaggtctggttccaaatagcattgcctttgttatccgtatagctgatgccatccttactgtaggtgaggaaacccttttcataatttaagcataccgcattatcatactgctgcttatcaacggaagaaagggtaacatagctcgtaaaaacctgatttttaagctgtacgtagatcgtggcgcccagggcggcacaaagaaggattaccagaatcgttctggaaataatggccatcctgtgtttaattatcaggtttcccatattttttgcagtttgtttattttctttacgctctgctcttttacgcagatagtcacgcacatttgacataaaaatcctcaaatcatgattgttctttcgcttcgctgtataaaaaaagccccgttgatgcaaaatcacgcggctttttttcacctggctctgccctattgggattataccataaattttcagttaggaagtaaaattttttgtcccggggtcagacgattggggttggaaatagaattcaattcgcagatttcatccattttatccagattaccgtaaaaacggcggcatatcagggcaaggctgtctccggactgtacgatatagctggaagggatctgtgcggaagccgctactgcatcggatgtaatatcagaagccggctggacctcagcatctgattccgtcggagtattctgaccttccgctgatgcggtatcctgatcgtctgctgcctggccggagttctgtgagtcctccggggactggccggctggcgcctgtgtttccggcacagagttctgtacctgctgttcaccggcatttgccgcatcaggaagagactgctgttcttccggcgctgttccattcaccgatgaagatatcaccggcagtgaaatactctctccggccgtaccgttatccgtatcaggcagggctgcctgtttttcttctatctggaaaccggtgttttccccactgcctgccgccgttttttcttctccgttattatcaagctggcctgccgcgccggcaaacatatttcccgcttctttcatatcattatagcgattaatggaagtcactccgattacgcagagtacaagaaggattgcaagtcctgccgccctgctgaaaaaagagctgtgggataccgctgcccgtctgctgttcgtctgttggctgtcaggccttttccggctataggtttcagccgcctgcataaccttttcctggccgctttccttctcagtctccggttccacattataattatgcggaaaacgtctgattctccggggttctgcgctgaccgtttctttttcttcagggggctccgccgtactttcatatgcccttctgctcttttcagggtttctcgccgctctgggcctgacctcctgcacggtttcaccgggctggttctggtgtaccgctataagataggactgcatatcctcattttgctcataaaaaataaaatagccttccagcggggtggcatagccgtcttcaaaaaaaagccaggcttcctgttcatccacagaagcctccccgattctgatctgtctggaaaaatatcttcttgccgtcatttcccatccgggtccttcttttgccgcaccataaataaaatagtaccggacttctccttctgtctccgtttttccatacaggcagaaatccgcggacttgtccccactccggttttgggaaagatatgtatatacgtagtcttctatgtatattttgtgacaggggtccacgtcgcctgcctgtaccacatttttaggaatctgcatactgccaccgcctttttttctttcaatatagcaaagaaaggacgcacattttggcggaatgcgcggcaatggtcatattcttttcgacaaaaaacggtatataaaaagccagaaccgcatagaatgcaaattctggctttcaggcttatcttcttttattcaaaacggaaaatggttatgctgtggtaatccttatccgggccgaaaactgcggaagggaaatccggttcattggccgtatcgggatagaactgtgtctccaggcagtaagcggtgcggcttccatagtttgccccgccctttccggtctgctcggccataccgttgctggtatagaactgtacgccgggaagatcagtaaataccttcatggttctgcttccggaaggattggttactgaggcaacaagtctcaccttgccgtcatagttatccaggcaccagttatggtcatagccgccaaccatttccagctgatcccattccttgtcgatttcttcccctatttttttaggagtattgaaatccatgggcgttccttccacaggaaccagtcttccggtaggaatagcgccgggaagaatctccgtaaaatatttggcatggatagtaacctgatgctcggatatatctcctgcatcatggccgtccaaattgaaataggaatggttggtcatattgataatcgtgtttttgtcgctgattccgctgtattccagcttgagttcattttcttcattaaccgaatatgtaaccttaagtgttttatttccggggaaccctaaatctgcatcaggcatatcgacggagaatacaacaccgttttcaatctcctgtgtttcccatattctcttatgaacgcccagctccttatggctgtggagattattcataccatcgtttggatccagatggtattccaccccgtcaagtatgaatctggcattggctatacggttggcattgggtccgataaccgctccgaagaagcagccgtttacaaaatattcggacagcttatcatagccaagaaccacatcagcggttctgccttctttgtcaggcacgattaaatccacaaggatggctccgtagttcatcaccttcgccttcatacccctgctgttggaaagggtataaaggtatacctcttttccctccttgtcagtaccaaaaagttccttctgtactcccattttccgctcccttctgcgtgcccgggcacgcctttacgcaaactgtttccgttacatttccactctgccttccagcgcgcgcagcagagtgacttcatctatatattcaaggtctccgcctaccgggacaccgctggcaattcttgtcaccttaattcctgtcggctttatgagcttcccgatatacatagctgttgtttccccttcaaggctggaattagtggctatgatcacttccttcacctctccggtaagacggtgcatcagctccttcagcttgatatcattgggcccaattcccagcatgggggaaatggcgccgtgaaggacatgatataccccttcatatttgccggttttttcataagctgccagatccctggtattttccaccaccatgatgacggaatggtctctgcgatcattcgcacagatcggacatttttcggagtccgtaagggtatagcattcttcacaatacctcacgtgttccttggcatccgtcatggttctggcaagtctctctactttagccgccggcatattgatgatatggaaggccagccgctgggcggatttgcttccgattcccggcaggcccgacagctcatcgattaacttattgatatatccgctgtaaagatccatcagaaaggaaagcctccgccaaggccgccggtcatcttgcccatcatttccgtattggcttcttccgccatgcgcagggcttcattggccgccgccaccacaagatcctcaagcatttcgatatcatcaggatccactacctcttcagacagctttacctttgtaatttccttcttaccggtaacagtgacttccaccgcacctcctccggcttttgccgtaaattccttggtttccagttctttctggctttcttccatctgacgctgcatcctctgtgcctgcttcatcaggttattcatatttccgggcataccgccgcccgggaatccgcctctttttgccataatctgttatgacctccttatttcttgcttttgttgttattcttcttctatttccatgtggatgatttgggttaaatccacgtaggaatcttcaaaatccctatcggaacgggaaaccgtcatatttacctcgacctttttctgagcgaattcggaaagcagcttctccagctcttccttattgccttcctgcttcaggaaataatcggaagcaaggccatcctccagcactatcatcagacggttatcaccgcccaggctgagtttcgcttttttcaggtacagcttcataggcatagccgtctgtcccaccagggtcggccaattggcaacgatattggatacatcctccggtatggccttgggaagctccgccatggaaataccggaacgggccgttttctgctccggggcgctgccctggactgccgtctgagccggctgctgcaggacaactcctttttccagctgctgttccacggcccggagcctgtcaagcagggaatcctggctgatctccatctgaggacggcacagcttaatcagcgccatttctattaaaatccgtttctggccggcatagcgtattcttccggaaagctcggaaagctcccggatatagcgcatgatggcatccgtttcggccatctgcgcttcttctttcagcctgacaagattatcactggaaacatcgaccacatcttctatagcattgtcttccgaggtctttatcagcagaaggttgcgcagataccaggtaaaatccgatacaaactgggacagctccctgccctgcatgacgatttcttccagaatgccgatgcagtccgtcacgctgcgttccagcacggcgcgaagaagccggctgaaaacctccgtatccacggctcccagcacatccagaaccatgtcgtaggtaagttcttttccataatgaaaggcaatgcactgatccaggaggctcagggcgtcacgcatggagccgtccgctgccttagccacataacgaagggctttttcctgcacctgctggttttcctgaaccatcagatcccgaagccggtcggtgattgtttctatggaaatcctcttaaagtcatatctctggcacctggaaagaatggtcaccggaattttatgcacctccgtggtggcaagtatgaatattacataagacggcggttcctccagggtttttaaaagggcgttaaaggctcctatggacagcatatgcacttcgtctataatataaaccttaaaacggccttcggcaggagaataagatacctcatccacaatttcgcggatgttatcgacaccgttgttggaagcggcgtcgatttctatcacattcatgctggcgcctgctgcaatggaacgacagcttcggcattccccgcagggagaaccgtcaaccggattttcgcagttgaccgcttttgcaaatattttggcaatggtcgttttgccggtccctcttgtcccgcagaacagataggcatggccgattcgatccgcctctatctgatttcttaatgtagtaacaatgtggtcctggcccttcacatcttcaaaacgttccggccggaatttacggtaaagagctgtgtaagacattttttacctcttcttaatcgccaaagctgattcccagcattttggcttcttttacaatggaagaattgggatctaccattttcagtttgcccgctacttcctcaaggggcacttttacgatttcccggttcttataacctaccataaaaccgtactctcccttcaggatcagcttgccggcttccgagccgaggcggcttgcgaacactctgtcataagggcagggagttccgcctctctgtgtatgcccgggcacggtcacccgcacttccattccgcttttcttggcgatctgatccgccagttcataggacacggacgggaaggtataattctccagttttttcttatattccttcttgctgagcttggcgtcttctttggagatagcgccttctgccactgcaaggatggtgaaacggcttcctctgtcatggcgttctttaatggctgcaataaccttatcgatatcatacgggatttcaggtatcaggatcaaatcggcaccgcctgccattcctgcatttaaggtgaggaaaccaaccttatggcccataacctccacgatgaatacccttccatgggaggcagccgtggtatggatattgtcaatggcttctgttgcgatgtttaccgcgctctggaagccaaaggtcatatcggttccccacagatcattatcaatggttttagggagagtaatgacattaagcccctcctctttcagcaggttagccgtcttatgggttccgttgcctcccaggataaccagacagtccagctgaagcttatgataattctgcttcatggcctccaccttgttcaggccgttttcatccggatcgcgcatgagcttaaagggcatccggctgctgcctaaaatggtgccgcctttggtaaggataccggaaaaatccgagctggtcaacatacggaattttccatagatcagacccttgtagccatccaggaatccatagatttccacttcctctttggcattgaacagtgttttggcaacgcctctcatagccgcattcagagcctggcagtccccgccgctggttaacattccaattcttatcatggacagaaccctccttttatctttgttttctgcaatctatcccacgcagcgccttgccctgcaggaaaatcaccaaaaaaacaatgccggaaatcccctgaagaaagccttccgcagatttagccggcgattccattatgcaacatattaacatagataaaatacactgattacttaaaattatacaatgttttgccggcttgtacaatgtttttttcgaatgccggttttcaaatcaggatataaaaataccggcagcttaataagacgccggtattttttatcttcattatgtatatggcataaagggttccggatgagatcagccttttacggccccggccatcatccctttaaccagcttatcctggaaagtaatgaataatataatcatcggcagtacagacagtaccagtacggacagtatgatcggaatatccagtgaatgttctcctttaaactgtcccagggccaagggcagagttttgttggaagccgtctgcaggagggtattggcaaatgcaaattcattccacatggaaacaccattataaatggccagtgtggaaagtcctgatttggaaagaggaaggatgatggcaaaaaaattcctgaacttgttgcagccgtctatttcggcggattcttcaatttccttcggaatggttgtcatgaaggctgtgaggataaatacggacatgggaagcgcaaaggtaacataggggcctaccagcgcctggaggctgtcgtacaatcccatatttgtggtcattttaaaaatggggatcagcgttacatgcatggggatggacatcattgccacaattcctgcatagataaaacccctcagcttgaatttcattcgggaaagagggtatgcggcaaaggcggaaatcaccagcatcagaatcaatgaaacggcaacgacaagcacacttcggaagaaatagccgaagaagccgtgggtcatgacctccacataattattgaaataccatggatggggaaggtggaacactccctgggccagcatatcaaactgtttgcggaaagagttcatgatcataaagaagaacggaaccagcgtaaccaccagccaggcacatgcaaagaaaatggcgatcgcccatgcaattctggatttcagcttttctttccggtaatcaacctctttttctccactcatttaatagtcctcctttactacaaaaatcttctggaacagcagcgcgatggcagttatcagaaggaacatacctgccgcgacacaggagccatagcccatattgaactgctggaaggacagcttatacatataagtagccatcaattccgttccccctgcaggaccgccgccggtcatattccaaatcatgtcaaaatatttcagggaaccaatcagggacatggtacatgcggtcttaaagatcggccccagcaggggaatggcaatctgcctcaggtactggcctcttgtggctccgtcgataacggccgcttcataaattgtggtatcaatatttccgtagccggcaataaaataaaccatatagaaaggggtaaactgccatgccataactccgattaccgaaaaaagcgcatgcgggtttcttcccagaagatccacagtcactttgcttcccttgatcagagttccgagggaggaaaagatacctccgttcgtagccagcgcataggtgaacaaaaaggcaatagctacggagctcatcagataaggcagaaaccatatgatcttaaagatattgaatttcttgcctcccgcgtccaaaaaggtggctagcagaaggccaaggggaatctgaagcaggatggaaaaaatcatgacaatcacattatggccgaatgcagaccagaaggaattatcagacagcagggttttccagttgctgattccgatatagattttatttgatgaaataccgttccagctgtaagcgcttgtcacaaaggtatcgatgacaggatagatcatatacaccactattaaaatcaatgcgggaaggaggaataccgcagccgctttggcggtactttttgctctcgctccggccagaccgtttgcttttttttcaggacccacattatctcctttccggtaaactattttcgaaatagtctgcctttcaaataattctgtagtaaaatccgcccgcaggagaaattttcctgcgggctttttgaacaacggatggcccgcactgcgtgacaaacgttgtttccaatcatcttatcgccggccctccgaattttattcggctatggccgccttcatagcggcatcctgctcctggcctatctgttcaggagttttctgcaggccgaacagttccgtcatacaatccttatgcacttccgtaaccgacgcaggcaggtactggtcataccatagctgcacattggatgcggtaaagaaaacatccgcaaccactttcatattaggatcatcaatggtttcttcaaatcctttgatagaaggaatggttccgctgtcaagctgtctctgattataggcatcatcgttataatactgtgttgcaagcacataacaggcatccagctttgtctgatccacggaaccgtcggcattccagcagttgaaggagaagccgttcccgatcgccgttccgatttcaacatcctggggaaccccttttgcggctgcttctgaatcctcagggaaacggaatacgccgatattctcatcgtaccattcctgattatccgccctgataccggatacctgccaggaaccgtgcagcatcatcgccgccgtgttgtcatacagcagggccttgtcctgtccgtcatctgtggaaagggagtttacaccatcggggaagtatcctttttttacccaatcctggatcttctctcctgcccagataaaggcatcggaggtaaaggagccttcctgggtataggcagcgtcaaattcagcatttcctgaatggcgcgctaccaggtacatataatacatggaaccggtccacttggatccgtttgccagtgcgaagggcacatagcctgctgccaccagcttatcacatgccgcttccagttcatcgatcgtcttgggaacttcgattcccacttctgcgaaaatagtcttattgtagaaaatatcgcatccggacaatccgccgaacggaatcgccagaatttttccatcataggatgcctgcgccaccgccgcatcgataaagtcgggatggtcataggtatgaaacatatccgtgatatcatttacaaaaccggatttataatattctgccatagggccgccgccccagtggatatacatatccggcgcctgtttggagctcatcgccaccaccagctgctgtttgtaattatcattctgctgatgcaccagattaatggtgatattggggtagtcatccataaatctctgtactgccccttccattgtggtcttgccgggatcttccgttgaaatatcccacagagtaattgtcagaggttctgtcgtcagctccggaaggttcttgccgtctgtctgttttccggaagcgcctgccgaagaggagtccgctgcttcggcagcagtttctgccttactctctgagccggctgcatttccggctgccggattgctctgactgccggaagaactcccggatccgcatccggcaagcatagtccctgctaaagcagccgcaagaacgatagataaaagctttctcttcatactgtttgtttcctccttgatttccgtaataaatgatatttccgcagccagacatacaggtattcaggcaactgacgggcccacttttccctctcggcaattcgcacaaagatatatcatttatacaatttttatagtgcaattatacccccccgtatttttgcaagcacttttgctaatttatttatgtttttaagcaaaaatatattgtatatgttaaagcgactattctttcccttttttcagccagttcacattacatatccgtaaaagaaagcagacataaaaataggctctttctcccatttaagagaaagagccaaaaataatttatcatatattttgtgatatcaggcgttctgttcctgaaagagaaccactccttttgtctgcagaacgatttcgtccccgggacggtattcttttccggtgagcaaatcggttcccggcttttcagcgataagcactgtttcctgaggattatggttcaggaagaagaggaaattagtaccttccttccggcgaagggtgatttccactcccttacagggcttgaaaaccggctccacgccctgctcttccagtacctttttaaggaaatcggcatagaaatcctgtccggcgcgggttgccacataataggcatggcctttgccgaattcatttctggacagcaccggggttcctttatagaagtctttatcatagcttgcaagggccttcgcgttttccatatgcatgatatcgcagatcaggccgcattcatagcttttttcgttccaggaaaaactgttcttcatatatgagggcagcgcatctgtttcttccacccagattcccaggatatcgcgcagctttccgggatatcctcctgtgatgacaagatcgtgctcatccacaaggccgcttaagaaggtggttacaaaggtgcctccttcggatacgaacttcctgattttttcatccgcaccgggctttgtcatgtacatcaccggggcgatcactactttgtaatcatccagcggatcctgtacggatatgatgtccacagagatattattgtcgtaaagagcggtataatagttggcgagttcgtccatgtatttcaggtcacagctggggcctgcggaatattccagcgcccaccagttatcccagtccacgagcatcgccactttggaaggcgtcctggaatccagggtggcttctcccagctgcttcagttcctctccaagctggcttacttcccggaacacccgggtattttcggtgccgacatggtcaatgaccgcgccgtggaatttttcacaggcgccgatgcttctgcgcatctggaaaaacatcacggtatccgcgccgtgcgccaccgcctgatagctgatgaggcgcatatccccggggcgtttcaggagattataggactgccagttggtcacgctgggagtctgttccatgagcatgaagggggcgccctgcttcagaccgcgcatcaggtcatggcgcatggcaaccagtgcgggtgatcggtgggatcgggataattatcccaggacaccacatccatatatccggcccatttctggtaatcgagagccttatagaagcccatcaggttggtggtcaccggaatatgaggggtaacagccttgaccgcttcatattctcccagatagttatggagaatggaatcggaattgaacctgcggtaatccagggaaattccctgaaatgtggtgcggtcctgggcaaaatgctcgctctgcaggttgggaacgacgatttcatcccaatcatagaaggtatgtccccagaagctggtgttccaggccttgttgagagcctcgatacttccgtacttttctttcagccatacgcggaacgctttttcgcagttttcgcagtagcattctccgccgtactcgttggaaatatgccaggccgcaatgttgtcatatgttccatagcgttctgccagcttacgggcgagggccacggaatatttttggtagacggggctgttgggacaggaattgtgcctgctgccgaattttcttttcatgccgttgaattccgtgcgcagcacttcgggatatttttttgccatccaggccggatgggccgccgtagaggtagccaacaccaccttcaggttattcttgcgaaccagctccataatcttatccagccgttcaaaatgataggttacctcatcggactgaagggccgcccagctgaatacgttcagtgtcacgcagtcaatccctgcgagacggaacatgcgcatgtcctcttcccaaactgcttcgtcccactgctccgggttataatcgccgccatataacatttttttaaccataatgctcctatctgtccgcagaagcggacctgcaatctgttatttataccttccagtcaaaacgggtgcacagccattcgcagctcaattcaaaccaatgggccacatggggataatcgtcccccacctcctgggtgcacatggacaggccgtgatgcccgtgctcgaaaaggtggcactctgccgggactccatgctcatacaggcttttcacaaagcgcatggtattggtgacgcacacgcagtcgtcatccatggtatgccagcagaaagcgggcgccgtatcttcgtccacctggttttccagcgaaaaataggcttcctcctcctctgtgcgttccgggcccagaagagcgctgaagctgtcatgccactccggatgaacctccttctgagcggaaatgacaggataggcaaggatcatggcatccgggcggttctgccgtccttttgccggacagagggcacggagcttttcactgttccagtggactcccaggctggctgccagatggcctccggcggagaagccgcagaccgcgattttggcgggatccactccgtattcttccgcgtgctccctgatatgtaccacacttgcggaaagctcgcataatggcgtaaaaccggttgccgggcgctccatttcctttccggcggtactgtaatagaggacaaatacctggaagccttttgcaaaataagcttccgctatgggatccgcttccctgtcggagcagtatttataagccccgccgggacatatcaccacacagggacgcgacttcctgcggggcatttcttcgtaataaggatgcagatatccggccagaagggtcccggaatcctgcaggggataaattgaaactgttttcatgtctgccatcactcctgttatacttatttatccataaagaaatggaacccacgccatgcgcgggtccatttcctttatacaatatcctgtgtatgccgtcaacaccggggaaggaatatacttttttcccgtatatcagccctttactccggcgaaggcaacgccttccacaatgtatttctgtccgatgcagtatacaatgatgatggggataaccgaacataccgtacctgccataatagcgccgtaatccgccgaaaactgctgctggaaggacgcaaggcccagctggatggttttcagtctgtcgctgtccaggtaaatcatggggcccatgtagtcgttccatacactgttgaaggtgaggacggtaagggtcgccagaccgttctgggacaggggaaggataattttgcggtaaatgccgaaggtggagcagccgtcaattttggccgcttcatgaaggctgttaggtatgctcagcatgttctggcggagaaggaatacgccgaaggcgctgaatgcctgcagtacaatgagggaaaggtgggtattgtacatgccgaacgccttaaccacgatgaactgagggatcatgatggcatgccagggaaccatcatggtcgccaggtaagccacaaatattttatctcttcccgggaactgcagcttggtaaatgcaaaggccgcaagggagcaggtgaacagctggagcagggtgatgataaccgccagcttcagggtgttcaggaaatactgcaggaagggtatgctctgccatactttttcataattcagtgtccggaacacttccggaatccactttacgggataggagaaaatctccgaattcagcttaaaggaagcgctgaccatccacacaaaggggactaacatcgtaaatgccacgatacagcagaaaaggaaaatcaggacagtgctgatttttaatttctttttgttctgttgctgtgcttgttttgccattgcggacctcctttaatcttcgtttacccagtttttctgacccttccactgaatcagggtgatgatcagaatgataacaaacaggaagtaagcgattgcggatgcatatcccatcttccattcaccgaatgcttccttgtaaatacggaatacaagcacactggtggagcgtcccggtcctccctgcgtggttacgttgatgatatcgaatacctggaaggatgcgataaagcacaggatggttaccatgaaggtggtgggggaaagcatgggccaggtcacattccagaaaattttccaggaattggcgccgtcaatctgcgccgcctcatacaggtgggtgggaatgctcttcaagccgcccataaacataatcatataatagccggcctgtttccatactactacgataataaccgtaagcagggccgttttggtggacataaaccatttgggcagatgctcctgggcaatgccgatagcacgaagcgcctggttgacaggtccgtcaaccggctggaacagcagcatggcaatacagccgatagctaccatggaagtcaggttggggaaaaagaacacggttttgaaaaatccgccgccaaacagcttccggttgagcgccagagcgagtatcagcgaaaaagctatggttagaggcacgctgactaaagaatataccaggttattcatcagagccgccttaaactgagagtccccgaacatttttaagtaattgctgatccctacaaatttccatttaaaaccgttgtaatccgtaaagctgattaaaagtcccaaaatgatcggaatggctgtaaagatgaaaaatccgatgaagttggggagcaaatacaggtatcctgtgatagcttcttttcttgccgccctgctcatccgtttcttaggttgtttcttcacggaagctgccatgcatattccctccttttttgtatatgccgatatccggtataccacccatgcccggcattcaatagccgttaaaatccggcgcccctgtgaagaggtgccggattaacgcggtttcccaagtacaatttctgtactcctgttgtcttagttcataatctcgtcacgtaactcggcgtaattactgaaggtttcatccagtgactgctcatccagcagataaagctgcagttcctgattgtaagcttcaatcagagaagcataaccttcttcacccttctgttcgtctttaatcttagctgagaaacggtaatcaacgcccggaacgttaacctgggatttgaatacttccagagcttcgtctgttgtataggaaggaacatcacagttttcagcgatgattgcggttccttcaggagaggtgcaatagaactcgatgaacttatatgcctcatccggatgcttggaggtagaggaaattaccaggtaagagctctgtccaacgctggagccttcttcttcgccttcaaaaatcggcagcggcgctgcgccccattcaaaatcagcttccatcaatctgaacatccagtcaccgttgatcatggtataaatattgcctgcctggaagtatgctgtgatatcaaaggtacctgaggtcatttctgcgattccgggagcacttgcatcttctacatacatacgatgctgaatctgtgcgaattcttttgtttttgtcaggttttcatcatcaaggtattcgcctgtgggaatagctcccaggttaggagtccagataggcataagcccgccccagtatttggttccgtcttcttcaccagtcagctccttaatcagatcaaggtattcattccatgtgaggttttcaggataatcaatgccttttgcgtcgaataattctttgttgtagaacatcatccagcaggatccgcttgtgggatatccgtaaaatgcgccgttggcatcggtaacgcctgcaagagaagtatccttgatggggcttaaatccacaccggtgctttccgcatagggagccaggtcaacaaatgcgccgttagctgtatactgtgccatctgggcaggtgtacgaacccaatagatatcagcatctgtggatccgccggctgtcataaccttaaccttatcatcataatcgccttctgcaatgctgtgtcctactacttcgatatcgctgttggctgcattgaatgcttccatttccttggtcgccactttttcaaggtctgtggaataatagaagttaataactgtcttgtctccgcccgcagccgcttcgtttcctgccgcttcgctctgtgctgcggtgtctcctgttgctgcgccggaacctgcagcgttatcggaagagctgctgccgcatcctgccagcatggtcactgccatcgctgcagtaagaagaatgcttaatgctttctttttcataattgcctcctttgaactaaaacatctcgtttcgtgtttcctgatgattttattataactgctgtaccgattctgaaaagtcacaaaaaatctacaccttttatacaaataaatcggttatgttttgtttacttttccgtgaaacacggcattttatgcttcttttttgctctgtccaatcaaaatagacaataaaaagaggatgagattttctacacccatcctctgaaacaagttatcgggaaaaagttaaccgcacctttttccagtattttatttttgaagcgcattcctcgtctgcatataatccttcattgcctgatccagggatttttcccctttcaggaaggaagcagcctccttgtcaaaaatatccctcatatcctggtaaagcacgtgcttgccctcttcattctgcagaatggcatcaaagaaaaatccggtctgtgcaaaatctacattctgcatatagttttctctgccgctctccgtgaaataggaggggaagcagtaccgggccgcaagaatggaggctccctcctccccgcagcagaattccaggaattcaaaggcattctccggataacggctttgggaataaaccgccagataggagttgcttcctatagaggttcccgcctccgctccattggtcagcggaagaggcgccgcatcccagcggcagttttccgttctggacgcctccaggttctgcaggatctgtatcgtccagtccccgtttatcatcattccaattttcccgtccaggaaggtatcatagccgggcgcatagatttcttccatttccaccgggttggggtggctgtgatccttgttataaagacgatccatgaatgtcaggaaatccatggtagcgggcagttcatcatcatacaggtattctcccagctccagggcgcccaggttgggaacccagatcggaagataaccgccccatctgacgttgtccggatcggtcccgttgatttttaccgccagctgcgcgtattcctcccagctcatctgtcccggatattccagctgaagctcatcgaaaatatccttattatagaatagaagccatatattctggataaagggcagggaataaatcctctcgtccagctggacgatatcaagggactgtccatatttggaaatatccagactgctgcggcttaccatatcggagagatcatagagtccgcctgattccgccatccggttggacttggagggctgacgcagccagaggatgtccggcttttcacctgattccagtacccgggttatttcgtcctcatagtccgaatcctccagataacgcatctccacctcagtggtgctgctctgggcattaaacacgcttaccagatcttccatataaggagcgctgaccgtcacatcatagcatatgattttttgttttcccaaaggctgtatttcacccggtacggtatcctgcctgtctccgtcttttccgcaggacgcaagcagaagggccgacaataccccaatcgccagaagggccggggctttcctttttcttttcatctcgtatccttcaagtccatattttttacattatggaggtaatcataaattttgagatcattcacaagcttaaccacctcagccatggaatccagatcgaatttcttaagaatattgtggatatgccgcttcagggtggtcatctccacgcagcgcatggaacagatttccgagcgttcatagccctgacgaagaagatccagaatatcgatttcggtctgtgtcagctgagtgaccagcatgaggttatacaggaagctgtcctcgctctgtttgacacgctggaattcccggcggattttctccgcaatcaccgggcggatcggggaacggccggcataggcatccttcacacaggcaatcagctcttcctgtttggaatttttgagaacataatcggaaacgcccagcttgaatgcctggaatacattttcatcatcctcataggaagtgagtatgatgatctttacctcaggatattgggagaggatctggctggcggcatccagccccgcggtccttgtttccatctcaatgtccatcaggatgacatccggctggcagagcacggtcttcatcaccgcctcatatccattctggacggctgccaccacctccagctcactgtccttttccagcagtctctggtatttttttaatagagcgggcatatcctccgcaatcagtactttaatcattatctggctcccatctgtacattcccatcagcggcgttaaatgcggcttaccggaagataaacatgaaatacggttcccttgcccacttcgctttccacatctattttgcccccggaatccgtaattattttatgggtcagtgataaccccatcccccagcttttcgtcatgggctttgacgtaaaaaacggggtgaatatattcaccatatcctctttggcaatcccgcagccattatccgttatttctatgattccccatctgctgtcctcaagtagcataacctggatttttttatctttatcctccgtctgcttcagggcatcacaggcattatttaaaaggttgatcagggcctgtttgataaattcttcatccgcaaagacacaggggtcttccccgggcacgctcacggaccattcgatatccgtttcaggccgtgaacccttcagttcctccacagtctccctcaccaggccgccaagctgcagctgcctgaaattcatggtattatccctgatatgtctgtgtatatcgtcaagccgttcataaagggcttcgcagtgctccacaagaagcgacttatcctcctcgctttcctgcagcacttccaggctctccacctccgcctgcaggttcagcagctcatttttcataaaatggcagaatacccgcgtggacatattgaccgcattgatgttttgggatacctcaaggctgtagttttccattttgttccggatcacattcagacggtagctccatgcgatcatgagcaggataaacaaaagtatgatatagggaagagcgcggtacaaggggatatagctgttcataaaaaggattttatacgtaaccacatccatggccttggaatactttatcatctgcatgggcaggcgccccatgaacataaggtaacagattatcagcataaaataggaaaacaatacgataatcagggacatcctgtataccttaatgtggggtacccggataatattgagcaggatactgcccaggcacataaaaagcagtatcaaattgattatggaaatggccgcgctgaaaatgccccaaagccgttcaatgccggatactgtcatataacccggatacaggaaggagtaggtgcggatgtataccgccgggctgcataccagatattccatcagaaagaaaagcccgataaccggataaagctttctgtatttcttcctttcctcctgcttcataaaagaagcggcaaatatcagattgctgaccgtaaaaaagatacagctcagattcaggcaattgataatcgcctccttggaaatcttcagggagtacagcctggcagccattccccggggcaccaggaaatacttgaggaagatactcaggttgaaggaagacttacaaaaatataaaataaaaaagcataatgacattataaagaaaaacagcaccagaaacatggacatcagctgcatggtacggtactcggaacgcgtgaacagcagcagcacaatcaccactgcgcacacaagcatcaaatatatcataaaaaggccctctttgcctgatttggttctttctccggtttgggtatggcgcaccgtatctctcccttcccggcagccgccttgcgggtcagtgttcctttcagggcacactctcgttcggccaaaaacgcagcagtactaacgttgcaaaggacgcaacgtaaggactggcgtttttagacggcccttacaggaatcactgacccgcaaggcggctgccgggaagggagagatacggtgcgccatacccaaaccggagaaagaacccctgattttatcggatcttttttgtatcttacaataattggccgggggtgtcaacggaatggggattggacagggaatattcattataaatacgcatgatattctgcaggagatccatatgctcaaagtccttatggtacaccatattgatttccctggtcatactcaggttctctatgggaagccctatcagcttgcccttcttcagttcgtttgcacaggcgctcctggccagaatggacacgccgaaatcccggcgcaccagatccttgatggtagctacattatctacttccagtatgacattaaattcatccaaagatacattattgctttccagatgagaaataaaaaggttccttgttcccgaatcgggaagacgcagaatcaggttctctttcttgagttcattcaatgtcaccatgcttttccgggacaggggatttttattggatacggcaaggatcagggaatctgtatccagcattatggcattgaaattggaatccgaaatacgtccctccacaatggccagatctatctcataggtcttaagcttcatataaagattatttatggtgtcagaaataattgttatgcgtgttttcttactcacactgctgtatctggcaaggacctccaccatgatattgctctccgaggtatgtgtgatccccaccgttatctttctggcatgttctttttcttccttcaggctctgctccaggttctgatacaggctgtcaatccttttggcatacttgatgacaatctctccctccctggtaagcttgagatttccttcaccccgggtaaaaatcgtaaccccaagctccttttccagctgccttacatgctggcttacggcaggctgggtaagagacagctttttggccgtctgggtaaagctgtgcagttcgttcaccgtaagcagggtgatgagtttgctgtcgatcacggaaatccctccttataaatttttatgatgaagtggttataaatcataatttgcctttatgaatctcgttgatataattgtaccatagaggggaaatatagcaatacaagggggaactttttcatgaaagatttttataccagcctgaacgagtcaacactcgttctgctttccttatccattatcctatttgcgggctttctgctcaccagactgactaaaaggcttcatctgcctaatgtcagcggctatattcttgccggtgtgctgatagggcctcaggttgcggcgttagtgcccgctcatattctgtcccacatgggttttatcagcgacatagcactcgcctttatcgctttcggagtcggaaatttttttaagaaggaggttcttataaagaccggctggaaggtagtgatagtcacgctttgggaatccgtgctggcaggcatcctgatcacgttaagcatgcgcttcctatttcatctgtcctgggacttctgcctgattctgggcgccatcgctacggctacggctcctgccagcacaatgatgaccatccggcagtaccgggccaaaggagattttgtaaatatcctcctgcaggtggtcgctcttgacgatgtggtctgtctgctcatattcagcgttgtggttgccgttattaatgcgggccgaagcgggcatgtccgggccggagacgtgctgctgcccattttttataatatcgccgccctgggaatcggattcctgtgcggttatctgctttcccggctcatcacgcccacacgaagcaaggataaccggcttattctcgccatcgccatgcttatgggaatttcagggctgtgctccgcctttgatctctccccgctgctttcctgcatggtattcggcgcttcttatattaatctgacggaagataagaagctgttccggcaggtagatcggtttacgccgcccgtcctctccatgtttttcatcgtatccggcatgaatctggatcttacggcgcttaaaaccgccggcatcatcggtatcgcttacttccttatccggatcctcggaaaatacggcggcatgtatctgggatgtgccataacgggaatgccggatacccataaaaaatatatggggctggcactgatccctcaggccggagttgccatcgggctcgctttcctgggacagaggcttcttcctgaaaatatagggaacctgctgctgaccatcattctgtcctcttccgtcctgtatgagcttgtcgggcccgcatgtgcaaagatgtcctttttcctttccggcacaataaagagggaaaaggctgcggcgaatgagaaaagtgacggggccggtacggcaaagaaggaaaaagctgcggtgaacgagaaaaacgaagggaagggaaaagtgaaaaaatatccggacaagaaatcggtgaagcatgcaatataagctttgttttatgggaaggaggcctgataagaaaggccccttcccgtttttttataatctgttattttactacttgcagaatatgcaaaagtactataaaatatatgtgttgtctttgcagcagaacgctgccacaccggtaacggtttccgctggaacagcatggagatgtacccaagaggtcgaagggaccgcactcgaaatgcggcaggtcggtttccccggcgcgtgggttcgactcccaccatctccgttagaaagccggaagcagtgaacaaagcaggcacgttacagaattattcattctgtaacgtgcctgtctgtgttctgagtttgaatgatgttctcgcttcggtcatgcaaattcggggaggatactttttccgttctttttatagcggctcaggaaagcagttcttccagcgtagcaagcagcctgtctacctctatcggcttggaaacatgggcgttcatgcccgcccgcagcgcttcgcgcacatcttcggcaaaggcattggcagtcatggcaactatgggaatactccctgcatccgtacgatgcatcccgcgtatttcccgggacgcctcatacccgtccagcttcggcatctggatatccatgagaatgatatcataatatccttctgcagaatccgcaaacatgcggacagcctcttccccgtcacaggccgtgtcgatttccatctccgtgcactttagcacctcaacggctatttcccggttcagctcgttatcctcagccagaagaagccttttccctctgcagcattctgtcttatctcttacagggccggaaccttcggaagacagaggatcaccctgcgcccggagcgttttttcctctttcttcagccggaaggtcaccgtaaagactgagcctttccccggactgctctctatccggatatccccgttcatcatatccacaatatttttggtaatggtcattcccagcccggttcctgcaattttctccacgtcgccctcccgggaccgttcaaacggattgaaaatctttttcagaaattcttctgtcatgccgattcccgtatccgtacatcggaaaataaagctgccatatcccagcttcagtccgtcctcctgccatacgtctatatatatccgtcctcctgcgggcgtatatttcacggcattgctcataatattcacaaatacctgacgcaggcgcagcggatctcccattacggtatcctcctcaagctccggaatacgggctgtcagttccagctgcttttcctctgcctgaggcctgattaattccactgcatccagtaccagacgggagaaaaggaaggcctcctctcttaaggccagtttcccgctctctattttggaaatatccagaatatcattaataagcccaagcagatggctgctggacaggctgattttatccaggcagtcctctatacggctcctgtcgtccaaatgtgacctggcgatggtggtcatcccgatgataccgttcatgggagtacggatgtcatggctcatattggagaggaagttactctttgcttcattggcggaacgggcggtatccagggcattctggaggacctgtctctgctgttcttcttcgtatttctgatcatcaatacagcgggcaagaaaaattgccagcttctcttccgtataaggattgtccacattaattctctgaagcagtacccagtgatactcattatcggcaagcagaatacggcactgggcaaaaacctccgtggaatgtgaagccggtgcctgaatgatgtgcccggcagcgaagcgtgagcggaatttttccctgtaatccggatgcagcctttcatccacaaagtccagaaggcctgaatagctgctgtaattctgaagcccctccagaaatccgggcttcacataaatcgttttcagagtatctgcagtcagatttacactgaggattacggcgtgagtgtcggaaattgcgcggattaatgtactgcgctccaaaagcttctctttcttttcctcctcctgggccagcctctccgatgtaatatcatggaaggtggctatgaggatcggttctccctcttcatccagcatcttttcaataatgcctgccgcccagaagtaggtaccgtccagccgctggaaacggcttacatacgaaatcttctgttccttttccatggcttcctgaaaacagggctttgtgctctcccagtcctccggatgaatcagctctctgagctgtttttccctgagggcatcattggatgcatattccggataattcagaaggcgcaggccctcatggttaatctggataaaacgaaaaggcgtatccttggaaatcagggcgactccttccggcaccgcattgtaaaggtggtcgatatagtccgcctgggtacgcagcttatggtaggttcttttcatctggagaatataaacgagggcaagcatgataatcgccagtgaaacagcaaccacaaagaagattgtccttcgcagaatatcatatgtctgctcactcaccactttctcaggaataatagaaagcagataccaatctgaaaagcccttcattggaacatagcagaaaaccgcatcagcatccccataggcaaagaccgcccagccgcttttaccggaaagcagagcctgacggaattcttccattgcccggctgtcattctttcccgcaggaagcatatcaaaaatatttttaactgtcttattgctgcccggatgaggcgaacggatcaggacatccccgccggtattaataatataggaaaaaccggcattattataaaaggaaaggctgaactcaccggcaatagccgcaacgttatattccttcaccagataatttatgcttccgtccgcaagccttacctgcgtataaaaatcaaacacgttaacaccagtactgctgctgatatgaggattgactatcccgtaatccataaggaactgatccgccatatacagatccgggccatccttttccggcacacaggttccgtcctgtaaatacaggcttactccattctccattttggaaaattcagtaacaatatccatgacgctttcccttgcgtctgccggaagcttttccagatatttttttatggaaataatagaagaaaaatcttctctgagctggatgttcagagcattttccccctgccgcgtgctttcgataattgtaccgacagactgctcccacagctgttcctttacctcattcacaaaggtaaacgtaagaattcccagcaggatgccgactgcggcaacagcaaaaaggaaccatcttcttaactgtacctcattatttttcatcgctccgcctctcctgcttccgcctgttcatccagccattccagaacctccgtcagttcttcgccggaaagcagctttactgcacattccgcagtaagatcccaaatcggcactttgaggtcactgtctgcgcctattaccgttctttcctcctgatacatgtcaatcagcggctgaatctccttcgaggaagccggagcgcctcccgtcagggggctgaaggaacattggttgtcagcaaatttccggatgttttcctgcccggtaaaatactccacaaatttctttgcttcttctttatatgggctgtccccattaactgcgatacgggtatccgcattaattaccaggactgaaccctgctccaataccggatatggcaccaccgtaaaacggagatccggagccattgccttgacacgatcagccgcccagccgcccgtaagcataaaaggggcgtttccctgcgcaaacagttccaggtcatcagaggtctttttcgtgacaagagcttcttcggaattgatatagcccttctttaaaaatgcttccgcgacggaaaaaccattcttcagatattctcccagtgattcttcccctctgtttattctgccgaatacctccttctggctgccttcctggtacagatgataaaagctgcggcctattgcaagggttttcagggatatatcgttatttgcaataacaggggtaattcccatgcctttaaaataatcacacacggcctcccattcagaaagggtttccggcacctcctgaccgttttcctccagcagatccagattgcagtacagcccaaaagcggaaacggtggtgggcacccagtagatttccccctcatcactcatctgatccagaatccgtacggtaaaatcaggaatcgtactgaggccggacagctcgcatagctttccttcctcctccagctgcagcgccgtatcatgatttaccataaaaatatcgtccccattcccggtttccatccgtttcatgagggcatcataataatcatttcccttcaggctttcataggaaatatagatatccggattttcctccataaaagaggtgagtatttcctcaataaccaccacattctccggttcatatttatttccgaaaaaagtgatttgcgcctcaggctctgctatatccggataggtttccacctttccctgtctgccgcagccggcagttaaaaataccgtcagcaaaactgccgctatccacttttttccttttatcccttttttcttcatacggaatgtctttccgggtgaggataaaatatatttacacagcatcccggagccttttcttttgatattaaggatattgtatcagaaaaactccctcaataaaagggaactttcaattaacgatgtttccagacatggctgggctgggcccgataagtcgggtaacgcaggagcagggttttcaaggcggcccagttaaagggatacagaggccagaagtagcttgccccggcgaatgtgggagttgtgatcacggaaagcaggaccagaaccagcccgccgataaagccccacagcctgaaaacagcggtcattaatatgataaatatacggtaaacgcggatggcgtcaccgaattccatactggaaagagcgacgctcgtcagcagtgtgatagacgcataaaataacacttccaccgtggcccaattcaggctgaccgcaatatccccgataataagaccgcctacaatggacagagagccggaaaaacggctggaacttagggaggcggagttcttaaacagatccaggccgaattccactaccagcacatagaaaatcaggtttatgggaggaatccttcctgatgtgagcagcttccatttatcggacagttccggataataggccgttatcagaagaaaaagcggcatcagaagcagacttataaaaatacagccgaaacgtaccagacgaaagtaatttcccaccaccgggcttttataataatcttccgggctctgggtaaactgaaatatagtacagggcaggatcagcgtctccggcgaattatccacgacgagcaggatatacccctccataagatagctgcaggccacatccggacgttccgtactgtgcaggctcggcagcggattataccatcttttatgcaccagaagctcttccaggcttttcgttcccatagtgagcgatgtaacctccaggctgtccagctttttccgtaaagtctccagcagttcttcattcaccgagccctttacataagcaatggccacatccgtcttgctttccgtacccacacttttcacctcaaaggtgagctttggggaacggatacggcgccgtatcagattggtattgaacagcatggtttccacaaaaccgtccctggatcccctggtaaccttctctgtgtcgggctcgtcgatacctctggcaggatacgtccggacatccatgataatagcctgttcaaatccgtctatcagcagaacggacgggccgctcaggatattttttacaatctcatcccagtcctccgtcaaggaaacctgggcataaccgattttggcattcatgtaatgcctgatatcttctatacaggaatccttcatatataaagggttctgaagatccgaaaaaatctgctgcagtatttccgtcctgcagaatccgttgataccgatccaatagcctcttgtttcccccaggaataaatctctggttatcatgtcaaaactggtgcctatgggcagaatctcttttgcagtctctatgttttcgtctatttgcgaagaaagctttctcatatatttactcctatctgtccgttaagcggacaagctgtcttttgcgactgttcagataactgtactgtaactgtctatttcctaccggatagtatgtgccgccggcaaaatccctatacttccgacaacttttaaaaatttatataaaatttatattctccccttgacaagcctttctgtacacgctatagttacagtataaactgtaattacaatttttacagaataaaaaaatacaaaagacaggaggatatgaatatgtctgttacagcaataggaaaagtaaattttgataaagaggtactgcagtctgagcttccggtcctggtggatttctgggccccctggtgcggatactgccggagactcagcccggttattgaccagcttgacgctgcatacgaaggacggctgtccatccgtaaagtgaatatcgatgaggaaccggaactggcggatacgtatgaagtggagaccatacccactctgtatttattccaaaaaggcaaagcccccgtatctgtcatagctccccaggccaagtcacaggtaacggactggctgaaggaaaacggcgtggattaagcagatatcatgttctatagaaagaagggttaacaaatgaaaaaagaactctacgatgtggtaattataggaggcggccccggcggatactctgccgcactgtattgtgccaggaacggatactccgtactcgttctcgaaaagctttccgcaggcggccagatggctaccaccggccaggtggacaactatcccggcttcgacgaaggaatcgacggcttcgaacttgctgaaaaaatgcagagaggcgcagaacgtttcggagtggaaaccgaatatgccgaggtgaactccgtggatttaagccctgcgattaaaaaaatcactacctcctctggaatcgtctccgcaagaagcgtgattgtggctaccggcgcttccccgagagaactgggcctcccggaagaatcatccttacgcggaagaggcgtggcatactgcgccgcatgtgacggccagatgtaccgcagcaaaacagttgccatagccggaggcggaaacagcgccgcagccgacgcccttctcctttccaaaatatgcgccaaggtttaccttgtccaccgccgcgacagcctcagagcctcccgcatctatatggaacccctgaaaaacagcggcgtggaattcgtatgggacagcaaaatcacagaaattctccacgacaaacgtgtttcaggaatccgcgtagaaaatgtaaaagacaagaccactaaagaaattcccgttgacggcgttttcgtcgcaataggccgggttcccgataccggattattcaaaggccagctggatctcgatccccacggctatatcatagccgatgaaagtacccgcaccaacatcgaaggtgtttttgccgtaggagacgtgcgtaccaaagcgctgaggcagattgtgactgccgccgcggacggagcaaacgcatcccattatattgaagagtatctgatgtaactaattctacgataacgtggaggggaagggagtatgattccggccccgtatccctggcgctgcattcggctgcctccctgcccggagcctctgcgccctccctcccctgccctgtgggattccttatgtatcatacggtacagacaaaaaaaggtgctgtttctaactgttttgtccctatcctttactgccaacgcggctgaactcctccctgcggtcgtcaaacaacgccgctaaggacgggcagtaaaggataggatcaaaacagtaagaaacagttacctttttttgagatgtaccgtatgatacataaggaatcccacagggcaggggagggagggcgcagaggctccgggcagggaggcagccgaatgcagcgccagggatacggggccggaatcatactcccttcctatatttatgccatcatctgtaaaagagtgaggacatcacctctgttcatgggatagaaggagccgcaggtgtgggttcctttgtctgtcataagatctgcaatcagctcgaatttttccttatcgataccggcttcgcttaaggttagcggcaaaccggattctttgatgagggatcgaagtctttttatgccttcttttgctgtttcccgagggttttcaaaattcatttgtgtgttccagacgcggactgccatctgggccagcttggggatacattcctgtttgtcagataaaaattgcatccaggcggggaaggagatggcaaggcccgctccgtgggcgatgtcataaaagccgctgatttggtgttccaggccgtggttgaaccagtcctgctgtctgccgcagccggtcatgtcgttctgggcccaggttccgcatagcatgatttcggctcttgcgtcataatcttgggggttttccagtgctttgggcaggttatggattacggtggtcaggattccttccgtcacgcgatctgtcatttccacatttggggtcctggtgaaatatctttccatggcgtgggccatgatatccatgcagccgcatgcggtttggtacggaggaagggtgaaggtcagttctggattcatgatggagaaaacagggcgcattaacggggagccgaagcctgttttcatgggaatggtttcatcggaaatgacgcagctgtcgctttcttcgctgcctgcggcggggagggtaaggatatctgcaacggggattcttttttctccgggtctggttttaccggaaatcagatcccatacatcgccttcataataaacgccgaaagacatggccttacaggtatcaataacacttccgcctccaactgccaaaaggaaatcaatatctttttcccggcagatttcaatcccttttcttaccagggatactctgggattagggactacgccaggtaattcctcgtaaaaaaggccggcttccttcagcgcatgaatcactttatcatacaggccgcttttctttatggaagagcctccgtaaacgagaaggactctggatgcaccgtactttttcagttcttctcctacgcacagttctttatcttttccgaaaatcatctttgttccgcattgaaattcaaatccgttcattgctgctccttttctttacaagataatcagttccttggggctcctggtcaggttttcaaatccgttttccctgaccactatcatatcttcaatccgtaccccgaatctttttttcaaataaatgccgggttccacggttatcacaattcccggtacaagcttgtcgttgcaaacttcattaaaccggggattttcatgaacctccacacctacgctgtggcccaggccatgggagaaacagccctcatagccttcctgatagataaatttacgggcggcggcgtccacctccgagcagactgctccggggcggatcttatcaaatgcccttttctgggcttcccggacagtctcatagacatgccgctgctcctccgatacgcttcctactgccacagtacgggtcatatccgccagatatcttccgcagacggcgccgaaatccatggtgacaaaatcccctttttgaatgaggcggcttgttgcaaatccatggggcagggagctgttggggccggatgccacaataaaattgaaattcttatcgtctgagcccagtctggtcaaggtgacgcctatttccctcgccacatcaatttccgtcaaaccgggctttatgaatccgagaatatgggaaaaggtatgatccgtgatttgctgtgcctttctgtggcaggcgatttcctcttcatccttttcccggcgcagggaatccatgaggccggaaaggctgtctgagatatccagcgaaattcccgtaagggcggtttccagctgtctgtacttttctaaggtaaccagtccggtatgcagggaaagagcggatattctttctgcctccaggagctgttttatctgggaattcaggtttttctcttcgattactctgcagttttttaccttttcttccgcttcttcgaaatagcggaaatcaatgatcagccatgccttatttcttgtgaccagcacggttcctgcagaggatttcattcctgtcaggtaaaaacggttggctgcgtcctgcaggattaccgcttccatgtcagaaggcatggcctgctgcagcctgattattttatccatatgcacttcctgtccgcatgcccgcacttcgggcatactataattttttcagcaggactgaataacattgtgccgcgtcttttactgcctgtatggaagcgtattcgttgtccccatggacaccgcttccctgttcgggcagggcatacatgggggaaaagcgcagtacattatctgtcagctccagaaaatgccgggagtccgtcccgccgcccaggacaaagggaattaccggaaggccgggatatgtttcttccacgctttccttcatcgacagatagcccggcgcaccggtactgctttccggcgcggcatctctgccgcctgccagttcacataacaggttatgtcttttggcggctattttcagtttttccgttatttcttccgccttttccgtacaggatacccgtacattggccgtcagcaccgctttcttcggcatgacattaaaggcggttcctccttctatcatggtaaaggcaatggtggttcccaaaagggtatccgcatccttacagatttcatgcagtacgggataatcttcctgttcatccgccgcctgcagaagcttatcccggatcgtgtccggggaatatccggctgcggcacgcagcattgcgcggtttccctcactcagctcttttcggaaaaaatcggcatactccacttcatggataaaatcagccagacgtacaatcgctgaatgggccggaggattggcggagtgtccgccccgggagagcgcggtaaaccggtattccagcgaacccttttccgctattccgaaaagggcggcttttccttttaccaggcccataaaatcatcacaaatggtgccgccttcgtcgaatactgtctcaaaatgtatttttttgtcctttaacagctttgctgcccggcctgtggtaaatccgcctgtttcttcatcgcaggaaagatacagccatatatcccgtttggggcgccagccttcttccagcaggctttcaaaggcggataataacgcgcattgaggtcccttcatatcctgagagcctcttccccagacacagccgtccgcgatccggccggaaaacggaggaaacttccaggaggcttcgtccgcggcgggaaccacgtccatgtgtccggtgaataatacgggaagaagggggccgggagttttctcctcatgaaggagatggctgccggttccccggagtttaagcaggagggcttcccctaccggtataatatcggcagcggtgaacaatgtttggaatgtggttctcagataatcccggtattcctctatgtggtaaaatggttcgtttccggcaccgctcacggtggggatcgatatcatggcggacaggttttcacctatattttcaaacattttttgttactccttcatgccggatacggcgattccctctacgaaaaattcctgagcaaagcaatataaaataagcagcggcagcatggatatcagcgcgcccgccagagcagggccagtctcacgcacaccttcccctacaaacatggcaagtccggcggagagtgtccgcatcttggtggaattggtcatcatcaaaggataaatcaggtcattccagttggaggtcagacagaaaatgaaaaaagtgacaaacgccggtttacataacgggaacatgatcttcgtataaataccgaattcattcataccatcaattctggccgcttcttccaggctcttggggagtcctatataaaaggaacgcatgaaaaacattccataagcagatgcaatacgcggcagaatcagcccgatataagtatttaatataccgaaggtatgcagttccaggtacaaagggatcatgatgatctggaacggaatcagcatagtgagaaggacaatattgaaaatgatttccttacctttaaattcaagacgggcaaaggcataaccggccatggaatccagaagggcggaacaaacggaaaccactcccgcaaaaataacagtattttttatataatccgccagggggattctggaccatacctggatatagtttttgattgtccatgctttgggccacaatgtgggcggccattttatgatatccttctgcagtttaaaggtgctcaatatcagccatacaaacggaaatacaatcaggaacagtacgaaaaggcatatgagaactctcagcacgtcataaactttaatttttttcttcatcctgctctcctcctacatgtttcttgctattttacgttccatatagcccttgaaaatcaatataataactgcgatgacaaagaataattcaatacacatggctgaagcgtatcccagatcataaggcgccgaaaagcctctgttatatatgtactgcaccactgtctccgttttgtaaagagggccgcctcccgtggtaacgtaaacaacgtcgaaaacctgaaaagccccgattattgtggtaagaagggtaaaattgatggtaggcagaagattgggcagtgtaatatggaaaaactgctgtgtcttcgtggccccgtcaatttccgaagcttcaaaataggtacttgggatatcattaatgcctgccaccagaatgatcagcgttttcccgaatgccttccaaacggaaatgaaaataatgataggcatggcaaatttcacttcactgagaagggctataggttcgccgtataccagactgatcagatagggaatataacctaccgtggaattcagaatcaggttgaataagataccgattgccgtaaaggaacatagtaccggcacataaaatacggagcggcacatcttattaaaacgggtgggcttatacagccaataggccagtaccagcgccacaataagctgaatgggcaccgatatcaccacataataaaatgtatttttgaatgcattccagacacgttcatcccccagcgtgcgtttaaagttatccagtcccacaaactgaggccatgccaggaaaatatccagatttgtcaggctgatgataaatgaaatcaccagaggaataatcgtaaatacaaataataccagtacagcaggaaaaataaacagatatcccactctgtcttttttcgtccatttggctatacatcttttcattgggctgattttttccatcctcaggctcccttctgaataaaggatgccgctgcctgcagccgcatcctttttcatagcttatcagaatttactatttcaaaataccctggatgacttcgttgtacttatccagtgttgtcttaatatctgcaccagcaaaaatttcttccatggcaggatataaaccatcggtcgagattgtatttacaccattcagcttacattcaatgtgtccgtaggaaagaggctccgataatgccagtgtctgcggatcatccgcgaaattagcctgtgcggaaagcagatatgcaggagtaccgcattcctttgtccatttggtacagatttcttccgtattccagtagtttacaaacttataaacaagttccttatgctcctctgaagtcgttttaggaatagaaaagcctacagggattaccgctgcatcctgctcaacgcccgtacatgcaggaaccgcttttacgccataattaatttcattttcacgaagcccgttaataatccagggaccgttgataaactgtgcaagctgaccgctgatataggtattatcatcggaatccttgggggaacattcatacagtgttttcaaggtttcaaaagcttttacgttctcctcggaattgaataccgcttctgtttcatcttcattcacgtagccgccgccataagcatacatggtatactgggcagtcacattattattgacaggcacgcagaagccgtactggtttttgctcttatccgtaagcagctttgcattctccacaagctcttcaaaggtttccggaggggattcgggatccagtcctgccgcttcataaagatctttatcccagtaaaaataatgagataccatctgcatgggaacaccaacgcataaatcatcataatacagcagatctacaacgtttttgtcaaagtcatcggcatttacttccggtaattcatagaaatcacttacatcctggaagctgccggcttccacataaggagcataatatccggaagaacaaagcacaaaatccggtgcatttcccgccgcaatagctgccggaagcttttcgttaaaggttgcccatggcattacgtccatttcaatggtaatattccattcgttcgacgcattaaaatcatccacaatctgctgaaggacttcaccgtctgtactggtaaatccattccagaaagtgagtgttgttggttcataggtcttttcttctcccgcttccgacgcatccgccgaatcggaaacagccgttgagggcgccgcgctttgcggttctgctgcttcaccggaagtatccgctgactgtccggaacatgcggtgagtgccaaagtcatggaaaacgccatccccaatgccaataatttgttccactttttcataatactcttcctttctatgtgtgctttttcttttttaaaagggaattccctttatttatcagatacttcttgccgcttcaataatccagcgtattctctcccagtcaagctttgcatctattgtgcagtccccgcccagcatcaatcctattttgccatgattgagaattaaatctgtggtgtatttctgcagttcttccttggtaccggtataaagaattccctgctgggtgtgttcgtcccaatgagtttcgaaaccgcccagggaggttctgcccccgataaaataacggccggcatccagagacaggccttccacaaatacagcccagtttactgcctttgcgggataatcctgccagattgcaagctggttccggtttcctgcccagccgcacatatgtatgatgttattctccgaaaaacggtttgcgtgctccagaacatacagatcactgggagtgatggtttttctgtattcttccggggtaaaacggtcatattccccgccctgcacacaatagtaaacgccgtcacagcccgcttccgtaataagcagctccgcaagaagggcattggactgtgcgatcacatccagagcgtccattacggcatttttatcttctcttatgtatcccattacatccgaatccgttaagcccactgcttccgcgccgaaacgaagggatgaaaagggagcgaatacattatagaaaacacagcgttcttttccgatatcctcaacgatagctttggctctctccacctgctccctgataaagggatgatcggaggtcagcggttttaagcttttccagtccgctgccgtttttatttccggcagcggatacgggaaataaccgtcgcacataatttttacaaaatccaagtccgtttcccgatagtattttaaatgtgcatttatgcagccctgaccggaagcttcttctccggcgaaatgaaaccagaagcctaccggaacatgatccacctcctttttattcattgcattcagaactcgtgtcctcttatccatttctttttcctcctttttatctgcaaaccatcatatccaaaatcacctgatccgtatcagccataccccggtttcccagttctcccagatttctgatggtgctttccacatcttccgttacaataccgtccaggccgccggcgctatgatttttcaaagccagcatagagcattggaacgcacttgaaataaccgttgctatttttaaagcacagcctgcttttgctccgtcacagataattcctgaaacatcggctatcatattattaatggcattcttaatttgcttcagtccgcctccctgcatatatacgaacgcgcagcaggctccgatggatgatcccatgccgcagccgcaaagcggtgaaagctttccaatatagcttttaacatgaatggttatcagacagctgagggccagcgaacggtacagcatttccggggagccttttcttttataaacagctgcaataaccggcaatgtggctgttaagccctgatttccgctgccgcacaccgtcattaccgacatggcgcatccggccattcttgcatctgccgccgctgcagttactgcaatagcataattccttatatcatccccggcggttccttctcccatatcttcatagatacttcgtcccacatggagcccataacgccctttcagcccttcctgagccaccgcccagttcatttttatacactcatcaaggaaagaaagccggtctgtatccacattctgtataaaatcataaatgttatccacagtaagcgctgatttatcactctcatccgccggaagctcctcgcagctccctttttcatagatacaggtaagcccatgtattatgcgggtaatattggtatgactgtcttcaataatgactgccgacatatcatcctctgtttccagaataacttctatgtaaagcttcttcggtgtatccttccgttccacacgaacctgtgtcccggcaaacagcctggcttcttccacctgttccggggtaatggagtgcaggacctccagaattgcttcactgtcaccgcctgtaattcccaatgctgccgccatttccagccctgccatatccgttccgggaatcccgactcccatggcatttttcaaaatattgcagcttacctttacctgtgcccgaaccggtttctttcccaaaaccgcccttgccttggcagaggcataagcaattgcaataggctccgtacaccctgttgccgccgccatttcctgtttcagaatctgcagaatctgattatgattcatctttttatcctcatacttataataatcgttatatgcataccgctgatatgattagcaatatgatatttagaatataatagaaatattataaaaaagcaagacattttttcttattttttatctttttgtacaattgcataaaaagaaggggcattttttgtgtattgtatagaaagacgtttccaaaaacaaaaccaggaaacgccgcaaaaatacatcctataacgaagaaaccgtccctgtctgccgacaaaggacggtttctccacttaatttatttcccctttttcagataagccttattctgcctcccgttccagccccatcctcacatactgttccttcggcgcgtcattctctttcataatccgcaccatttccttcctgaaatactcctccacttccggattagatataggttctgactccttcggatccttctccaaatcaaaaagcagcgttttataaggatgctcccccaatccattcgtatactctcttttttccacattctttattttaagaagccggcagcccttcgtaaaagaaaaaggctcactcaattccagcccctgcagctcctccggaggaaacatctcccgcatatgagtcggcatcaaagtataattataaaacggctcattggttttaaccgccggagccagcacataggcataatgcccgtccgtacagcttatctgcgcgccgcaggtcccatacagacaggtttcccgcaccggtttcccttccgcaatcgtatccttcagcacatgccccagcatatcccccggtataggcagcccaaaaaactccaacagcgtaggcgccaaatcaatcgtctgcacaagacactcacaccgccccgccgccctgcttctgggatcataaataaacaaaggcgtatgaacgatctcctcataaaaattaatttcattactcttcgcccaccaatcatgctctcccaacataaaaccatgatccgtattcacgatcagcatcgtatcttcccacagattatactcatccatcttatccaaaatcttccccagattccgatcacacatctgaagcagcgccgcatacttattacgcacatgctgcacataaggccgttcctcctccgttaccctgtgatatccaggccagtcaaacaggggaccgtcatactccgcctcaaaccccatcaaatcctcatcctgaacataaaaaggctcatgcggatcaaaagtctccacctgaaggaaccaattatccgccccatgattcctctccagaaattccacccccgcccggaacgtaacactctgagccatcctgtcttccgtatccgtatattcccggttaaccatatcctgcttaccgcactgcccgatatgagcaggaagcaccttatccccgacacaccccttccagggatccccctcctgtcccctaacattttcccagctgctgtaccgattatgataagtacacccgccatcctcccaataatgataatggtcactgatcaaatgcgaataaatcccattcctcttcaaaatctccggcatagaatcatcataaggttccataggcccccagctccgatgcaggaaattataacgccccgtatgaatctccctccgcgccggcatacaaggcagactccccacataacacttatcaaaagtaacacacctctccgccagcctctcaaaattaggcgtcttagtccactcacacccataaggcgcaagcatatgccgattcaaagaatcatacataatcattatagccttcattataccttctctcctttatcaggaacgaaacgtatattgtctcatatacgccagtatatcctgcttttctttaatacaattatgcctttcctgagaatcctttgtcaaatcatatagttcatcctcatcattataatttcgaatccatttatatcttccgtcaaaaagcatcatcgtattatgtaactcacttttctggaattttttaatttcttttttttctcctctgattaaaggaagaatagaaactccatccatttcctttatgttataatccactccagccaattccagaaaagtcggcgcaagatccattaattctactaatgcatgattccggctttcattcgtatatcccggaatatttataactaaaggaatgcgcaatgcgccttcatacattactgatttttgaaaaagattatgatctccgagcatctccccatgatctgcacaaaaaaccaccacagtattctgacacatttctcttcgctccaacacatccagaattctgcctatgcagtcatcaattgcaactacagaagcagcatagtgcttttttaaattttgtactttttccggtgtcagaccataactttgattctgggcttttttcttaatccaaactggtttaccctgcatatcatcctctattgaagggggatatatgatatctccaaccttagagagggcatattccgggggatcccagggatcatggggtccggcaaaactgaccattaaatgccatggatactcctcgcccacctgctctaaaaattcacaggccttcctgccaatataagtatcctggaaatcttcatctctaagtacacttttctcagcataccataccggaagtttttccaaacgcttatggtaatcctttgtaatagaatccaatactcccttagtttccagatatctttgataggggcctaccagttcttttgttccatcttctttcactggataaaaagccagattcatctttccttcgacttcatcaggatctgtgaatccataatgatacataaccggaagaggtgcattctttccataataatgataatctttatgtaaatctgtcttacctataactgcagtgcgatatccatttttccgcagcagctgataatatgtaatctgatctaatgggagcgatgcatcatgtaccataacaccacagttatggggatactttcctgtagccaatgatgccctgctgggtgtacacagaggtgaagtacaactggctttatcaaaaaacactcccttcctgataattcggtctatatggggggtcttaatcccgccccccatttgtgtcatagaatctgtccgaaattgatctgccattatcaataataagtttggcttcattttatttcatcaactctttcattctgtcatagtactcctgcatcaactgggtatatctttcactattaaactttttcactgcatccaaatgctgttcccatttcttattatctataccattcataacactttctgcaagaaagttgtccatataggctcttaactctgtcagaattacatttatttcctggaccgcttccggataattttggccgtcaggcataaattcttccactgcacaggccaggaaaggttcctgccttgctacatatttcttttctctgtcagatgtaatagcaaaacgagcattatccgcttcactccaaagggtagctccctttactcccatggacagtgtatgtcttacttcagcataactgttataaccatcaggtacagggtccgctagtttggaaatcgttccgtccccattatccttccatgcaacgccttcaggtccccaatcaaaggttaaacggttctcaaagctgccgttcatataatcatatagtctaagcatggcttccggatacttacaattcttagtaatcgtaaactgattggcaatcacacctcctgcataagagctaggaacaaaacgtcttatcccttcctcatctttcaaaggaagaagatatgtgtagtccttagcataatctcctactgtaatatcatcatatgaataattaggaaatactcccagctggttgttcgtgcctttggctatcatatcaacttcttcctgtataaacccattaggatccacaagtccgtttgcatataatttattcaaatactgtagataattatagtaattctctgtttccgggtaaaattctacctttccattcttaatttgcacataaggaaatgaataatctttagcatcataccccgcgatcccaaaagcagacattaagagatcaaatttccgatccttataaaaagagaatggaatctcatcagcctgtccatttccattaggatcctgttctttaaatgccatcaatacatcaaacaattcatctgcagtatttggcatttccataccaaccgcatccaaccatgtttgattgatagagagacatttaccagctctatatccattcatttgtacatccggcaggccataagtagatccatcaggaaatactgctgcaaccttaatggcaggatattcttcataaaaatcggcaagcgaaggagtgtaatctgcaatcatatcatccaacttataaaaagaatcaagaaactgagcaaaattgggaacctgcccgataaaaacatccggtaaatccccggccgctatcataatagcaacttggtcattatatgaagcttccggaatccccacccactcaattttcagcccggtatcctccactatctgctggacgaaatccttgttttcccatgaaccaatcttatctgtagatgccactgaatggacaattttaaaggtataatctacattcataattggatatcctgtcttatttacggcatttggtacttctactgaagctgtttcttctacacttccagaagattctacgactgctgtaccatttgttttcccacagccagtaagatttccaataatcaaaattgtggccatagtcgcggcaataacttgttttagtttcattctttctccctccaaattaattatctgctatttttatgccaggcatccgtcaccccttgacggagccgatcataacaccttttacaaaatacttctgcaggaacggatacacacagatgaccggcagcgaggatacaataatcaccacatatttgataatctgggccaccttctgccgttccaccagagcctcaatttcagccggatccgttatctgggtcagctgctgtcccagaatcaggatgtcccgcagcaccagctgaagcgggtatatcttctggtcggtcacgtaaatcatcgccgtaaaataggaattccactggctgacgcccacataaagggcgataaccgcaataatcgctttggaacagggcaatgcgattttgaaaaagaatttccccaccccgcagccgtccagctccgcggcttcgaaaagctcttccggaaggctgttctggaaaaaggtcctggcaataatcatgttatagacggtaaccgtccccatcaccaccaggacagttctcgtattcaccatatgaaggctgctgaccaccatataggtgggaatcagtccgcctgaaaagaacatggtgaatacaaaaagcttggttatcacattccttccgaaaagatccttcctggataaggcaaatgccgccatcagggtaacgctggttcctaacagagttccgaaaaaggtgtaaaaaatggtattcaggtagcctctccatattttccattcctccagcacaaacttataggctgcgaaattgattcccgatggaagaaacctcacctttcccagggaaatatcctccggcgagctgatggaggcaatgattacaaaatacaggggatacaggacgataaccagcaccaccagggatatcacggtaaccgtgatattaaatatcctgtcttcccttccggcttttatttttttcgtttccataaccttcctcccttaccacaatgaattttccgtcgtttttcccgcgatctggttaacgagaatcaggatggtgaaattgatgatattgttaaaaaggccgatggcggaagcataggaatactgctgcccctgaagaccgattttgtaaacataggtgctgatgacttccgccgtggaaagattgggcgccgtctgcatcagatataccttttcaaagcccaggttcatgatatttccgcagttcagtatgagcagaatcaccgccgtgggaatcagcatgggaatatcaatgtaaaaaatacgctgcagcttgttggccccgtccgcgatagccgcttcatgcagttccgggctgacgccggaaagcgcggctatgtagataatggaggaccagccggtcgtctgccagatggcggaccagacatacagatgagggaaggccgccggatccgtaagtacctgtgggttgctcattccgaatccctttaatatgctggttccgattcccgacgccgggtcaaagaagacaaacatcatacctaccagcacgaccgtggaaataaagtggggcgcataggtcgcggtctgtgtgatttttttcagccgctggctgggcgtataattcagaatcaacgccagtatgatggggatggggaagctgaacaccagctggtaaaggctgattaccagtgtgtttttcagcagcttccagaacatgggcgaggtaaaaaactgccggaaatacttgaagcccacccattcactgccccagattcctttggtcgccacaaaatccttaaaggctatctgcagccccgccagaggcatgtaattaaaaatgaaaacgtagatgatcatgggaagcagaaataaatacagaattgaatttttcttcagactcttcctgaactttactttgtttttcaaggcccctcattcctttcttttcctgatgagcctattttagcaaaggaaaggagaagagcctatgaagcgaaatcagtgattttggtaaaatactcagttttttacaaaatacccgtttcttctatgggaagtctcactgtcacagtcacctttccgtccttcccttccacggtaagtcccccttcctccccatacatcagcttcaggcggctctgtatgttgacaaggccgatccgttttcttgcacgtctttcctgctccagaagctccctgtccgccagggtttcctgcagctttgcaagccgctctccttccagccggcctccgttgtcaatgatggaaaagacaaggctttgtccttcccgtcttccctttatccaaagcattccgcctggctcggtgcgtttttccagcccatggtaaaccgcattttcaacaagcggctgaagtatcattttgtcgataggaagatccccgatgccttcctccatctccatttcccagcggaatcttccgttaaatctcacgtcgcatatatccaggtattttttcaggaaatccgtttcctcccttaccgttaccttgtcgccttccttaatggaatagcggaagatttcagccatgttggaggccatctccgctaccagcggttgatcgttcatcagcgcgatgcctcccatgcactgcagggtattgtagaggaaatggggattgatctggctccgcagggcataaatttcactctcggtttttacaagctccgtttcatagaggcgctgctgggtatcgaagatacgctgggacatctgtgcgttattcttcagcatttcattcatcttatccacaaggggtgtgagctggaagtggtattttccggtgatctgttttttcctccggttcgtaccaagctccgccacttcttctatcagcctgtcgatgggatgggctattgtctggttgaacagccatccgataaggagaagcataccgaccatgaccgcgcagcttaacagcatctggcttcggaacaggtcatattcccgcaccacctgatggttattgatttttccgactatccggaagccctggccgccccatatttcccgctccagataggtatagccgggctgctccctctccagcacctccgccccggaattggcggctattatgcggccccggggatcgagaagatagaattccacctcttccgcatttccggtctcctccagcaccttcatgatggcgttggggcgtatgaccagcatcacggttccgatccgctggctttccgtaaaaatagccgctttattggagtaaatgggggtaatgcagagaagcgcttccctgccgtcgtcgcctttataaaagataaagcggttgtttaccgcctctttatagcattcccgttccaccttctgaagctcttcctggaatttcatttctgaggagctgtagctgtattcgcattttccttctttattgaacagaagggccgtctgaatctgggaattcatggctaccgccgcctggcaggtatcattcacaaatgtcagcatccggtatttttccagctgctcctcctccgccaggaactgctgcactccggaattgatggaaaaataggtggtggtataggcaatgcttttaaacgcggaatccaggttattttctatctgctttaccgtggtattggtgtaggaaagcagacgctgtgccgaattctcagcaattttatgtatgtaaataaactggctgcccacctggatcagaatggctgccaggatgatcagtacaatgcttttcttaaaactcagtctcatagctgtccctcatctgtgttccggtttcccgtgttccttctctgtctccggtactggctcggcgtctcgccgctgtatttcttgaacaccttattaaaataatagtaatcctgtataccgcactgtaccgcaatttcttccagggacagcgtggtatgcgtcagaaggcgttccgcctctttcatgcgtatggaagccagatattcggaaaaagaaccgcctgtctctttgttgaacagggcgcagcagtagttcgcattgagatgaaactgatccgcaagctccctgagcaccagtttttcccggaaatgggtgtgcataaaggtcagcatttcctggaataccggattttccgcaagagggatttcttccttttcctgtttctgttcctttgtttcctccagtatgccgtgcagcttatccagcagaagggtgagcttgtccctggcaatgggcttcaggcaatagtcatataccactcccatccggatcgcttcctgggcatagccgaattccgcaaacccgctgatgaccacgaagcggcagggaagctttgcttccagggccttgtgcataaatgcaagcccgtccagctccggcatacggatatcaatgaaaataacatccggcggctctgccgccgcccggttaaatgcttccacggaattttcaaacttacccgtaatccggaagcccatttcctcccacttcactattttttccagatagacgagcgcccatggctcgtcatccactaaataaacgctgtatgtatccattttcccgccccatgcctttcctgtgattcgttactactgttgtgcttactcctgttttaatcaagtctatcatcgttctttcttttccacaattctattctttttccgataagcgcagaaatacctttctttctatatggatatccgttaaaatcaaatcagagattatcggatgggacgcaatacattatgtataatgaatacaagggggatacgagggaaatggattggacagcaagactgaataaggtgatggattatgtggaggaaaatatccacggagagatagcagaggaagaaatcagcaggattacggcctgtccgtatactatgttccaaagctctttttcccagatcgtggggattcccttttccgaatatgtgagaagaaggcgtctgaccatggcagcctatgagctgctcaataccaacaggaaaatcattgatatcgccatggattacggatatcagtcggacgatgcattccgggtagcctttaaaaacctgcatggcatcaatcctgcggaggtccggaaggccaaccctcccctggtgttttactgccgcctggattttgaaataaacataaaaggagtggataagatgaattacagcgtagtggaaaaggatgcctttcaggtgattggcatacggagaatcaccccttacgggggcggaacctgggccatcgtaaaaagcgacggaagtaatgaccggattcgggatctgaccggaagcttcttcgatttgggcctttgcttcggctttgatgaaaagggaaacgacgattatatgtgtgccgtcgaatgcagcgattaccagggggacgagtattccgtctatcagtaccctgcggctacctggctgaaattcgaggcaaagggcaagatttcggataatacgctgggcagcgtctggcagcagatcaacaatgaattcctgccctccagcaagttccataagggaccgcttccgacgattgaaaaatatgtattgtggaatgacgcggaggatatctgcctggtggaaatatggattcctcaataacggcctaaaaaaacggttcccgggaatatcacatcaccggaaaccgttttttaagctcattttcatttatactgtctgttaattatgctgccctacgataacgttccacggcattcagcacatcctggtcttctcctttggagtttacaaataccagatcaagcgctttaccaataccaagggcaaatacacccaaaatggatttggcatccactgtgtagctgccgagagcaagatcatattctccttcaaactgtctcattgtctgaacaaaggcttctgcggccgctgcattttccaaataaatttttacggatttcatatgatacctcctgtaatttctcattcgtaaagctatgtattgtttaacttccacatcatttttattttacttatcatacataaaaaaggcccctatgttaggaggaaaattttaacatagggggaaatttttgtacttttaaacctgtttttttgcactaaccgttcatttggcggtattctgcgggcagtacgcccaccacatccttaaataccttgctcatatatttggggtctgaaaagcctgtcatcgccgctatctgagtcaggttctggttggttcccagcagaagcgtcttcaccttttccacctttacattacggattccctccgtaaatgaaatgcctgtttcctttttaaactgcctgcttaagtactcaggggacacgcccagcttcctggcaacctcctccatggtgattccctggctgtaatattcttcaatcatgtgttcggcgcgctggatcaggggactgcgttccccggtttcctcatttccgcccagcattatttttttataaaggctgcgcatgatattttctatatcctcccaggtaaaggcgcccatgacagcctccagcagcgcctggacctccagctcgttctcttcaaaggatatgtattcccttgccgtattcagaatcgtccacaaaaaggtgatgcaggcttccttgatatccttcggcctgtgtgtctgggcccggcagtaattcaggaactccacataacaggcggcaaattccttctcgtccttctttatcacagcctgcttcagccgaagggacatttcaggcaggtatttcaggggcgaaacagaaatcccatcgatccgtttctgcgaaataagcttttcatttccaagggcaaggctccagtcaagcagctgccttatgcgcttccggccttcctccagttcataaaagccctggcattcttcccatacacacaatgccttgttttccgtattggagagaatcatgggcactacggagctgtcaaaatattcctcccagtcctgggcggtatccatatggtaaagcaccatggtacactgggtcctttccgcaaaggccgtgacaatactgcggaagtcggcagcatgctccgccacctcctgaaggatccgaagtacgatgtcctttctttcctcataatggccgtccagccatacaataaataaagccgtcggctccgtagcgctcacgccatactttttttccagcgcggcggtcgtctcttctgttttttcaaggattccggtcagggcgctgcgcgctatattttccaggctcagaagcgtttcctggctgttttcctccctgacttcttcctccatttgctgcaggaccttacgaagctcctggatttttacaggcttcagaagataattgctcacccccagctccatggcacgcttcgcataagaaaaatcagaataggcactcaggatcacggccttgcttgttacgccctcttccctgagcttctccagcatggtaaggccgtccatatccggcatccttatatccataatgaccacatccggtttttccctccggataacctcaagcccctccagcccatcgcatgccttacctgccagcacataggaagaactcagctttttcaggattttttccatgccctcacgtatgggggcttcatcctcaactatcacaattctcaataatttgtccctccaaaattggtataaacagggttacctttgtatatttattcagactgctttcaaaatgcagcgcggcggcctctccgtaatagagccgcagacgttttctggcattttctatgccgaaatgattttcccgatggtagtccttttggttcaggatatccacaagctccggcggcatgcctcttccgttatcttccacctctattatgagtccgtccttctcccgccttcctgttatcataagcagcggggccctgtctattccatgcagcccgtgcttgatgctgttttccgcaatgggctggagaagcagcttatgcatcggacttttcgcggctatggaatccaggctgcagaaaatctgaatctcctgacccagtttttcctgctgcaggcgcacatactttttcagccaggcgatttcttcgcccagcgtggtgattcctcctgcatttttgatggcataacgcaggatatcacctaaatcgccaaccatctcactgatttcgtactcttccttttcgatggccttccagttaatggtatccaaagtattataaagaaaatgaggatctatctgggcctccagggcggatatctccgcattcttctgttccagggccgcctgtcttacctgccccagaagcaaatccgtccgcttaaccatttcattgaagccgtcggcgatttcattcatttcggcgggcatatttttccgcttctccacacgtgtggaaaaatccccttcttccacacggttcatggccttcagcatatcctctaccgaaacaataacaggccgtgtgacaatcagcaccgccgctaccagaacgactcccactcccaaaaccaggccgatttgaaggaggaactggtcgaacatggttttccggtaatgctccatggaataaaattccactatgttccatccgctcacttcattttctgcgaaggccaccacataatcctggtattttttatttccgatataccaaaactcatcacagcctatagatgcccctatcagcgtatcatccggtgcactgagaacacgtccatcctgttccagataataaacctccccggaaattctttccatagctttctgcagtaccttctcatttacacatatgagaatgcttcctacctctttatggatatcccggtagtctatcagccttctttgaatggaaaacacatagacgggggtatccggcgccgccatgacatatttcacaggctggtacatttccattttatcctgcagaagattcatgctgctgttcagccagaggctttcactggaggatgatgacagtccgtcataataaatgcagtttccgtccctggtaaatatggccagtccggtcaccccttcattccggttgcagatatgcttcagctcccggcggagattgattttcagcatctcctcatttttcccgcctgcattcaggctttccaccatatcaatgatatcatcgtcggtactgagatcatacagaagggtatcatatttttccagggtcagcgtaaggctcctgttcgatttttccaggccggtctgaacacggctgtccaggctttccctcatggcggaattcagccgaagctgggatactgccgcaaaaagcaggataggaataaaaagcaggaggatcagcataaaaatcagtctgatccggatacctctcggttttttcatcggccgcctccccgttccagaatcatggttattttcccgtccgtttcctgcaggacaggctccatctcttctcccaatattgcccactccatggcggaggtgatttccgctgatacctccggccaccagggagtaaagtcacggcacctcgcagcggagaacagccggacgaactcctgcatctgctcatcctccgggaactgccgttccagcacatcctcccttggcgccaggaaaccgaaatcatccagatagctttgcatcctttccggttccgccagaaaatgcagaaattccatggcctcatccggatgaccatccgtggatacccctatgatctctcctcccacagtagtcaccgcctcaccgtcagaaggaatgggcgctatgccgaaatcgatttccggagcattttttctgatatatcctaccgtcatgccggtattgaacatcatcgccactcttcccttggaaaactggtacatcaaatcggccagggtcatgctgacactctggctgttcagcgccccctgtcccgccaggctggaaagcataccgaaggaagcccgtcccgccggactgtttatattcttcacatccccgcccatggaccacaggatgggaagaaatgcatacaggctttcttcactccggatacccgccatggcaaagccgtaatgcgattccccggtggcacgcaccgccgtatcatagaactcctcccaggttcccgggacaccgcagcctgcctccgccagcatctgtttgttataaatgagggcgggacagttcattccgaagggaagtccatagaacctgccgccgctttcgcagggggccagcgcctttggcatataagaagaaagctcaggaaattcatccgtcaaatccataaatttcttcatatgatggaaaaactggaaatcagaggaatccacaagtgcgatatccggcattgtttcctccgccatactcagcgccagctgcttcttaaaatcctcatccggtacatattttatttccacagtgattcgatcctgggagttattgaattccaatgcaagccttgacatggccttctgacaggcgggtatatcccaataatgccacagagtaaccactgtcctgaccggttcctccggaatcttatccatcttcttcccgcagccgcccgcaaaaagaagcagcattattaacagcgcgatcccagcccttttcccatgtttactgccgttcattcccattctcctttatccggcctgcttatgacagacgatcccggtataaaccggtatcccgccggttacagcccggagacagacggctccggggataaaatacatagatacagtatagcatcaaaaagtttgtctttctacataatccggaataaaacagagcgtatcccgcattgttttccggttctcacccatggacagggggaaacgggtactgcagaggatacgctctttttctaattgcttccttatattttctaatttacttcatccattttggctgctattttttcagccagctcccggcacagatcttcgtcctgcgcctccaccaggattcggatcacgggctccgtaccgcttttacggatcagcacccgtcctgaaccatccagctgtgcggatgcctgatcaatgctttctttgacggacgggttctccagaacctccgccgcgtcttttacccttttattgatctgtactttagggaacaggctgactcctgcggtgaggaaggaggccattgtcttcttctccacgatgatttccatcacccggatcgcagtgaggatgccgtccccggtggtgctgtatttattgaaaataatatgtccggattcctctccgccgatgctgtagccatgctcctgcatctccagggagacatatttatcgcccacaggagtacgcttcatgcagatcccctgtctctccagcgccttttccacgcccatgttggaggcgatggtggcgactacggtgttatcgatcagcgcatgctcttccttcatgtgtaccgcacacagatacataatcaaatcgccgtcaagcacatttcccaattcatccacggcaaagcatctgtccgcgtccccgtcaaaagcaaagcctgcatccaggcccttttccaccacgaatttctgcagggattcaatatgggtggaaccgcagtccacattgatattcagtccgtccggttcgtcatgaagcatgtaggtcttcgcacccagcatctcaaatacggttttggctatactgcttgccgctccgtttgcacagtccagccccactttatatcccctgaaagaatggatcgtggtggaggtcagataactgatatattggtttcttccctgtatataatctgtaatcttgccgatattttcatttctggcacaggtgatttccacctttccgtccaggtattcttccactttttccagaacggaatcttccattttgaagccgtccttgtctatgattttaatgccgttgtcataaaaaggattatggctggcggtgatcatgatgccgaaatcaaaatccccgctttttgttacataagatacactcggtgtggtagtgacatgcagcaggttcacatccacgccgccggagcttaagcccgccgccagggcatattcaaacatgtagctggaacgccttgtgtccttgcctatcacacagctggctttccttcgggctccgtccgtaaagtaccagcccaggaattttccgatattgaacgcatgatccgctgttaacacctcattggcttttcctctgaaaccgtctgttccgaaatatttcattttaaacctctctgcgtgctgcggcacgcatgcggctgacgccgcctgctgtcttactaatccaaagaccggatacacatttttatccgtatcagttttatgccgctgtatatacggcatgggcagatttgttttcctgccggaattgggataacattcctttttttgttattcgtttgccattttaccacaaatcaggctgatgtgcactattatttcctttttttgcacgaaagtggcatgtttatgaaatttttttaatatagccttgtctgaaagcctgtttttcttcaggattttttccagtttatcaccgtgtgaatttaatattttaatcttatgcttaaagaaagatcagtatgaacgtaaaaggaggagcttatgagggataatctgggaaatgcagaccgggaaaagaaacaggatatgcaggaaaaacctgtgcatggctttttttatcacttgttcggtattctcaaggccgcagcgctgattattatctttcttatcgccgcttccgccgcattgcatcagactatgaccgtttgggaaaagggccggactccgccggcaggcgatctggtcacggcagacggtcataaaatgagtatttatgtaactggacggggagagaacacaatagtactgctgccgggcctgggtaccgccgcaccgatcctggatttcatgcctctggcacaggctcttgcccgggaaaaccgggttgtggttgtggagcctctggggtatggctggagcgataccacaaaagaagcccgtacggttgaaaatacggtggaggagcttcggagcgctttaaaggcggaggggctggacggcccttatgtattgatgcctcattctatttccggtattgacgccctgtattatgccaatacctatccggatgaagtatgtgcggttatcggaattgactgcacgctgcctgctatgccggattatttcggggagggggaaccagcacaggttccggccgtattgggactgcttaatcccgtggggatcatacgatggtcctgtatgctgaatccggatgcttatatttccgataatagttccggcttatatacaccgggcaatcttgccatgcagaaacgaatcgccgcccggatgggacagaatgcaacggtaatcgatcagatgaaccggattggggataatctggagattacaagggatatgaaatttgacagtcagctgccgctgctgttttttacccgggacggcagcagccaggaggcgagggaagatgggaaaagcagtggttccttttatcagacttatgtgtcgaatgaggagtgtcagagagtggttcctttgaacgggggacattacctgcattggacctgcagtgaagaaatggcggaggaggttggggtgtttctgcgtaccatgtcagacaaccggtaatcctgttttttatgatcgggtaaggctacatacaaagcatgcagccttaccgtagcagttaattattttatttatacatagccatatattccccatgggcttctatcaattcatcacacatgctgcggatatcatcaatattcagctccgccgccgtatgaggatccagcatggcagcctggtaaatataattcttatctctcgttctggcagcctcgatggtaagcagctgcacattgatattggtctggttcattgctgccagctgcacgggcaggcggcctacatgacagggattgactcccttggcattgatcatacaaggaacctccacacaggcatcggagggaaggttatcaatcagcccggtgttcaggacgttgccgccaatctggtaaggcttgttggtcaccactgcctccatgatataagaagcatattccctggaacgctcatgggtgattttaccatccttaaggatattgtttctctcctcttcccattcagcgatctgcttgatacagcgtctgggatattcatccagcggaatgttgaatttatcaatcatttccggataacgggatttgataaaaaacggattgtactcggagttatgctcgctagattcggtgcagtagtagcctaaagtccttatgtattcataacgcaccatatcattgtgcttttctttgctgtttttctccagcgcacgctttttgatttccggatacaaatcgtttccgtccttatcctttacttcaaggagccatgccatatggttgattcctgcaatgtaatccgttgcgccttccagcttgtcttccattcccagacccttcaaaagcccttccgtacaaacctgaacgctgtggcagagaccaacggtcctgattttgctgtatctctgcatataaccgctgaggattgccatgggattggtataattcaaaaacagggtatcagggcaaacctcttccatatcccttgcgaaaccttccataacagggatggtgcggagcccgcgcatgattccgccgattcccagggtatcaccgatagtctgcttaaggccgtattttttggggatttcaaaatccgttacggtacagggctcataaccgccgacctggatagcgtttactacgaagtccgcatcacgcagcgctgccttccggttctccacgcccagatacgttttgattaccgccctgtcttcatttacgttgtgattgatggccctgaggattgtttcggaatcctccagccttttggcattgatatcatacagcgcgatttccgcctctcttaaaaccggtgtgcacatacagtcacccagaacatttctggcaaaaacagtgctccccgcgcctaaaaatgtgattttaaccataaagtaaccctcctgtaattgaatttatgaaatgaatcctgtaaaattaagtatctgcttttattttacgttttttcacgatttattctttatattttgtttcttattattgaatttttgtttcctatggagagttttatgatgaacgaaagcccagaaaaaaataacccgcgtgagactgtccgcctgcttaccgaatcccagacacgcattgccctccggctctattattccggcagtgaatcctgcgctcccggccattttttcggccctgcaatcaggccccattacctgattcactttatccggagcggaagaggaaaatatatttgtcaggacagtattttcgagttggagaagggagacgcctttttaatccttcccggagagactacaaagtacatcgcggatgaaaaagagccctgggagtatagctggatcgcatttgacggcccggatgcccgcactttgctgaagcactgcggatttacagatactcaggtggtttaccgctcccctgacaaggaaagtgcggaaaagcttctggcccaaaccagcgtattcgaaaacagttttcatgagaacagccagaatctgctggaaatcatggggaatttttatcttttattttcctgcatgtatcaggagcagatgcctgtccccctgctgactccttcccggcagtcctcccctgcggggacgctgcaggagctttatttccgccaggctgtggaatatctgaagcacaatttcagttatcccgtaaaaatagaacagctggcccgccaggtgggggtcagccgtacatatctgtataagatctttatttcccattccgggaaaagcgtccagcaataccttcaagacctgcggcttaccgccgccatggatatgctgaaaaagtcaggaagggatatcacggaaatcgcctattcctgtggttttacggattccccggccttctgcaggcagtttaaaaagactaccgggctgacgccgctgcagtacaggcgggctgcggggaattatggggattcctaagattcccggatgctgtaggtactcaaacgcccaggctttccagaaagccttcgcagccttcacatacatcgcggtaggtggcctcaaagttgccggtgtaccatggatcggcgatggccccggggcgatctgtgtaatccaggagaagatggactttgttttccggatcggaacgaaggatgcgcatgatattgcgcaggttcatttcgtccatgccgataatgtagtcaaatttcgtataatcttcttttctcatctgacgggcctgcttgaaggaaatttcctctttggaaattccatgctcgagaagcttgcggcgggttccgtgatggaccgggttgccgatttcttctgtgctggtggccgcggattcgatgtggaaatcgttggcgatacctttggcgcggaccatgtctcttaggatgaattctgccatgggggaacggcagatgttaccatggcagacgaatagtatttttatcatcttgaatatatcctttcataagcctttaagtcttgattttgcaggctttccggcgcttttcttcaattttgcattttaccccaaactcacataattctatgtaaatctacactttttcttcaagcgttggatacacatcttcaccggaaaagctttgataaattgcctgttccaatccataggttaccaattcgtcctgcatggttctcccatcttcttttgccagattttttaatctgtcttttaccgatactgcgcttatcatacaagtacctccagatatgttttcataacttctccacatttaagcatctccgcataacgcagcagtctgtttagatttctatcctttctcctaaggtagtttacaagaatctccttcgtttcttcgattcctaccttctccctgaagcagacgatgtctacaactgtcttttcaacatcatatattttaaaatgattccgaccttcctgtactgtttcaattcctgttttaaagcggtcatctgcataatagtacacagatagtaccggccaatccggcattgtagaaatctttgcttttctctggatagcaacgtctacagaatccggcctaaatgttgtcagattgtaataggacgctgcactcataagacaaaccacacctttcggtgcatatgcctgaacgtagtaaaaatcagattcttcaccattatattctgtattttcatagtacttcttattaagttttaggagtgtgccatcttcaaccaactgattaattttgtaatgagaatatcccgctttttttagttcatctaccgaaaatatcatctgatcgcgtggaagtttaagtccgttaaccattcatatcacctcacgatttaagcattccgatttttcataattatgattttaataaaattcggcatttttttgcttttgccgaattttattaaaatcatatctccgaatatcagaaatgtcaactgtaaagtgaatttcaatggtttacaatcaaaaaacaaataatcccttagtgtcatacaaatccctcctctaaccattctttttatttcaggacatcattctgctttccaactcattttcaatacaaatacacagattcgtataccgattcaccgaattcaaatctttttcaatatagtcccaggatcctttatagtctccagtaacagaaaatggtgatttgcaaatgaactctttgaatgcttccaccttgcccttatacttttttgcaaaaacataagcatcattttctttgtctttatccgtactattttgcttatcgtacaatacgtgatccaaattacaggacatataatataggctatatggaattgtccaaattatgccacagcttctcaacctatataaattatctcttttctgttgatttcttgtcataacacttgctttattatttgtatatatcccctcattttcataccggatatctaaataattttctttttccatgatattatcatccggaatatagactccgtccgtatcaactatatgaatgatctgcttaaaatcacttgctttataatgctgtgattttgcgtaagcagttacttcattgccaagctttgcaactatatttttcgaacttacaccgcgtcgtgtagtaatatcaccatgcataatatgaacataaataaagtctttatcatatacctggctcaatgccataccaagagcgacttcatccgaaggtccttccactattaccaatacaatcttcttacgagccaatcgcttcacccgcctccctgaatgctaatgctatctcaaagttatttgtgtgattatatacctgctcgctttgttctcccagtacaatatctcgataatagaaatcgcgcagattatttgtacccttaacatttcccatccgaatataacgcatttcaggatttgttgtcgtaaatgcgacaaatcccttatctatagtctcaagcgggcgaagattgtgggatgtaaatatcagctgcccctttcccttctctgaaatgattttaaggagttcacccaataaatattcaaaaatcccaccatcaagttcatcaaccgccacagtaacagatgcattgttataaactgcaatcagtaattgaagaatagatacaatcttcttgattccttccgattcatagcaaaatggaattgacctgctgttttttaacgacataatctgaatctgctttccaatactgccattcttcaataaagctgcacccaaatccactatactaattgtaagtcccggcactaactgttctaagacaatattcatattttgaataattttatccacaacatcatatgcctcttcaggaataagtgcaggtctgtctaatggtaataccaaacttcctgcagtatcagcacctttactgctatatttgaaagataacggcaacgaattaagactgattaatccgatactttccgtgtctattacgaacaattctcttatcccaaaccagttaagatgattaatcagattgatgtagacttcattcttgcaattctttctgaacacattaatcatctctcgtgagaaaatgaaagaacgggatgttgcctgtgtcagtctctttgtaactaacagattcatattttgcgatttatcatttcctaccaattccacaaatttagttttgggaacaaatatttcctcacttcttgtatcaatcagagccgactttctgagcttctcttctttattcgtaaagccataggatagtatctcgtcatatatttcaacccttatatggggctgtgctgaattactatcctctgtatctatcgaatcattatcttctgcttttcgtaatgaaaattgataccaaatatcatactttacctcttcatcacatactaaaaattgatatgttaatgtagacttttccgaatccacattgacataatttgcatactttgaaggaatcgctttcccactcaacgcaaacttaagcagctgtaaagcatctataagtgctgttttaccggatccattctgtccgtacaatcccaatatgcttgctttgtaattttttcttttgttttcaaaattaagataaccgtatttcacattttttaagttctcaatacttatattttcaattcttacagtttgtttgctcatagtatcatcctccataagcacataatatcattcaatttttatttttacaacatcaaacttatatattggtatattttatttcgtttttataattcatctcgataaatattaatttcgtatactatatgctgatttggatttctctatatgttctgcaatcatttatagctattttatcaaatcaattcccttcaaaataaggaaagcaaagtacagactgccgtcttttcaattcattttctattcccactcttttcataacacatattaccagatttagctgatttatacgattatggtttacagcatactcttttttatgtagtcttttagaatagaattcgcccattttgcgccggaaattcctatttcgtaaaatccgacctttactctcccgtctctttccactcattcttcctgctgctttcatatgaaaaagccctggcgtaatgctagtattgcattaccagagctttttccattggcatcataaaaaaatccgaatactgataataggtcatgtctgaatccgggtcatttgataataccacggattcattgagcgcatgaatccatactacttccgttgttcccaaactctctttaataatttggcttactatatctgcaggaatatcagacctgtaaataattttatcatctgctgtcgctaatgtcccgccatatccaacaaaaacatcaggcataaaccgttcgagagatttctcagacacttttgctgatcttgcagtggcaaatactactttaatccccgtcgcctgacacttttagagtatatacacagtgtaatcagaaatagtcttatcgcttctgagaagagtatcatccaaatccgttattatcatctttaccatttctgattaactcccaatcttattttatgacaatttatgaaatccctccggtaatttttttcaaacactcctgataaatgtcagctgtcctgtctatgattgtgtccggaacgttatcatactggatttcgccgccgttcttgttgctgagtagccagtcacgaataaactgcttgtcatagcttttaggggacacaccgacctgataatccgcgacgctccagaaacggcttgagtcgggtgtgaatatttcatccgcaaggacaagattattctctttatccagcccgaattcaaactttgtgtccgcaataatgatccctttctcatatgcaaatttataacataagtcataaagtttttgacaaagataattgatttttccggcagtttcgctgccaagtgcgtttataacatagtcaaaggggacatatgtgtcgtgtccttcgcttgtttttgtcgaaggcgtgagaatcggcgtttccagtttttgtgcctgctgatagttcccctctatttttaacccgcagaactcttttccatcttgataggcattccacatattaccaaacatatatcctcttacgataaactcaaacggtaatatctgcaacttttcaacaagaatgctgcgttcctcaaattctgagttccggaaaaactttggcatatccgagagcttatcggataaaacatgatttttgacaatatctttcgtataatcaaaccaaaaaagggataatgcgttcagtactttccccttgtcttttaccggtttggataaaatcacatcaaatgccgatattctgtccgtggtaacgattactaaatgattatcgtcgatttcataaacatcccttactttgccgctgattattttttgcatattccgaatacctcccagtttgtcatcaccaattgagattattttcaaatactaccgaagcgccgtctttaacgacttcaccaatcggatagcattcatagaaatttgatatcgtttttgatattatggtttccgcctgtgcttccactacgataacaagacccacaccacagttaaaggtcctgagcatttcattttctgcgacattcccgttggatttgatatattgaaaaacaggtggtacgacaatacggtccagattaattctcgcggataaaccatccggtataatgcgcgacagatttccctgaatacctccgcctgtaatatgagccatcccatgaacggagggaagtcctaaaattcgttttactgccctgtaataaggtgtgtgcggtttcataatcgcctcaaggaacgtttccgtaccgatcatttcattttgaatctgcggcatggaatccatcaaaaaccttactaaagaatagccgtttgtatgtaatccgtttgacgccaccgcgagtagcttatcgccggcctgtattttagaaccgtcaattattttttctctgtcgacaatccccgctatgcttgcggttaatacataatctcctttgtcgaccacaccgggctgtatggacatttcgccgccgactaaatcacattcattttcccggcaggactcggatattcctttgataatcgatcggatggtatccttttccgcgttgccgcaaataatggtatccagaacggcaagcggctttgctcccataacgataatatcgtttacaagatgattgatcatatcatggcaaatagattcggtatatccatatctcgtggcaagcttttgcttggaaccgggttcctcggacttcaaaacaagcacagggttctcaatatcatcaaaccgtacgtcatataatgaagcgaaaggtccgatcccatttaaaacacgcggattttgtgaatggagataaactgccatttcacgcttaatcgaatccgtgtgcgaaatatccacgcccgctttctcatatgtcagccccgcatcaaacgaatcccgtgcattcaatatctcatcggttgtggttcccaaaagacgtgaaagcgcatagagcaattcaattgtcggatacgatatgccgctctcccattttgaaaccgcctggaaagatatatttaaagcatccgccacctgttgctgtgtgaagcctttcgcttttcgtttgtccgctataaacgccgctatcttcttgttatcaagcatcaaaatcacctcccttactgaaattatagcatggctatgcgaatctacaataaccggatatttgatatatcgttcttctttcaacctgtggtagagctgcgcgttgtcgaactatatgtattccaaacagaaaagcaacgcaattcagttatttcggataatcgaataatcttccgtatattctcctgtctctaaattataaattaaaatctgatatggcttatctaacgaaatccaaacagcaaaattctgaggttcaaaatcgccgtctgtgattagttgattgttaaatcgccagtatgatgcgttttcgccaaccacagtgtcaacataataacatataccttctattccatttacatattcaattccactaatataacttaaagcatctttgtctttatccagttcaggtaaacggctatatatttcatcttctaattctgccagcttttcgtagtgatcgttttcccagctatatacttccagcctgtcatactccggactcgcaagataagccgtcttccccttcatatttggaattgaaatggtaaaatctgtctttttctgctggaatggtaagttttctgctccataaacaagtacatggactacatcagcttcttctttactctcttcccatacgacacggctgatatggtaagatgacagattaatcgtgccgcttatagtaagagattctgttttttcatcgtatgaaatgtttgtggcattcacttcatgtgatgataaaagttcacctatcacaaaaacttttaaaaagatagataatagaagcagtgtcaataaccctgcaaaaattccaatcgttatttttaatttttttgtatgctgctgtaccttcttaaaaccgtccagtgcaagagtttcatttagttcttcttctgagttcaagccctccttcatttccaaataaacatgattacatttttcacattcctctaaatgttctttcaccacgcgtgttcctgtttcacttaatatctcatcaatataaccgggaagcaaatcctggataatgtcacaaggataattttcattcatactttttcaactcctctcttattttttgttttgcccgataaaatacagttctactccaattctcactctttcctaagatttctcctatttcacggaaagacagttctcccgtaattcgatacaaaaccacttcacgttcccgttccggcaggagatgaatttctcggtaaagttctattttactttcttgtttcagtatactggtttcaccatttggtgcagaatcatcggttaagcaatctactaattctaccgtttctatctgcttttttttacgaagttcctgatagagtatatgcttggctatctgacaaagccatacagacagcttacaggtaccatcataccgtgaaatagaatttaccgcccgcaaaaacgtttcctgcatgagttcttgagaccattctgcgtcatgtgtatgagaatacaaaaaccgataaactaatttctcatattccctatagacagaatccatatctatgctcttgtcgtatttctccatctattcacctcccgtccgcaaaaaatgccgttcacaaatccgctctattaatgaatcattacttataccacttatatcacataatagagccctctgttacaagctaaagtgatttttctactacctttttttgatttacagattctaatattatgtgcttttatagatctgtgggatgatgtggaagctgtcgatcaaattcttaaattctttatggcacatgatcatttattcgatgattttttatttttccacaaaataaaatcggcagtcctgaattaaaaggtactgtcgattttctaatttttattgcatcaaaatattatcacgtaaatatgcataattccgttatttcccgcaagtcacccgctaatcacgaaggcaattcaaccagaatctcccatctgccattacgtttcccattcattcgccgtatatattgcttgtcctgcagcattgccattttatttttcaccgtacggtccgattttccaatctttacagcaatttctttttgtgtaatggcaggatctgcagcaatcaatctgagaatagcaagctcttccaaagtgaaattcaaagtgaaattttttccctttagaacattcttcatttcactttgaatattccctgtttccaacttcgattcgtaatccacatgaataaaacgatttttcaattcataatttgtattcagcaaaagattactaaaaaataattccagatattcggttgtcgcatgaattccatttttcagattattataattagcccgtaccaatgcgtttcggaaataccatgaatgttcagcaaacacatcattacttacttccaaaccaaaagtcttcatatatttaatgacaaatacagcagtcgtccttgtattcccttcacaaaaaggatggatttgccagatatcagatgtaaattttgccagatgcttcaccgattcctgaagtgacaagccctcataagagaactgcttttcggtataaaaatcatactccaaagtatctttgatgctatcgcaggcagcataaattacactatcccccttcagtacccactctcttttggatatattatatggtctgattctccctgcatgttcaaacactccttcaaataaacgccgatgaatcgtcagcaattcgaccggagaaaactgaaaagtccgttctcctaaaagcatcgcaatcctggcagagacaatatccgcttccattgtttctgcctgcacctctaaacgctccgaacgctcttcatagtagttttgtattcttctctgggcttcacttatacttatttttccctcaatatgtcctttggctgtatccaacaggtaatcagaagttttgagaccatccacatcctgcagtccgattgcagtctgccatatttcgcatttttctgtctgttccggttccccctgccggatatattcttcaagctcaaactgccattttttttcttcgggcatgttttatacctctttctgaaaatcttcttgttattaatcttattaaaattcagtatatcataaataatctaaaagggtcatctgtaacaattctgccgccatggccggaatctctgactaactttctaagagaatccacattatatgcttcgatattcatcccgaaaataccctttcactcatcccaatcccaatccaagaaccttctccaacacctcaaatactaccatctctttccctacactcttcgccagtctccgcactccttccagcgccttcatccgtcccttcttactttctctttcgttcagcagataataaatctcctgctgcatgctccacggcagttcataaatttgctcatccccgtccagttcatccggagtgatatcactatcctcatctaccgcaatagtaaaaggctccttccccgtccgccgtgcgagactcgtcctgctgtagcctttcaaacaggccaggggcgtatccagccagcattttgccataaccatccaaatcattgtgagctgcagcatatttacagggtcttccggctcatctgtcataatttcctcaatgatataaagtaattcatgtagctccagccccgataccgtttcctgatatagctccggtaaaaattcctccagcgcctccggcagtaaaacttccagatttaccagaatttcccccaaatcttcccaggcgggaacaaaaccggcgatcccctctttccattttaatagctgtttatttttaaaatctgcatattccagtccctgtccgtacgctttcatctgttccagaatctggtttgcatccagtccgccaaaggaaacaaaagatgtaactgtattatcaataagacattctcccgtttcatatttcccaaataaacgtccgtcaagataaacatacctcatcaggtcttcataagctatcggtccgaacgctttctgatatttctcatgaaggacgctcgactccataaatccataactctgcatcagataaaaaataccatccgtaacaaattttttagtactgtaaaactggtgcagtctgtttgacttcaagaactgaagcaggatttcatttccttttgcagcggaaatatccattctgtttttaccggactttttatatatctttacatcccaaagtccccatgtacacaacacaaccagactttcttcagaaatggcaggaaaaaacttacctgcattcttttccacactcaaaagataattctgcaccgttatttcatccataaaaataagataatattcgggatgagcctgcagcacttctaaaatagcctgctctgtgtcttttttgcttctgctttctcccggaggaatcatcagatattttgcataatcattaattaactgttctgcgccctgtgccagaagctcttcctgagtaatatcactgtcacatttacaaaaataaaaatccggcagttcttcttctatatctgtttcgcctgtttcaaaattaaaaacaaactgtccctcattggactgctgtccttcctttatctgcctggctgaccctgaaagcttctgcagcttatccatttcttcgtaaaaattatgtatctcttctatcttcagttccatggctgattttttctttggccgctgtatcttttgtttcagccccattttcttcataaagtcatctaacagaacttccgttaccagtatatcctctccggcttcccccgcaaaaacttcgcagaaacagttctctttaagcaaagaatttactctttcctcgtcataaatctcactgctttcctctccgtaccatgcaccgccgctgtcttcttccatattgccgcgtttatgtttaaccactgtcgggtaacgtttctcataatcctccagttctttttccaaaacaatcttatggcgccagtcatcaccaaaatcatacgtataccttatccatccggctttcaaataggaatccgcacacacatccttttcatccaaatctgcatccgcatactccgtatcactgattcttaccctgcttctctgaaaagaaaaatcatgcagatgctcttcctgccatccaaacacaatctgaagaatcacatgcaaatcagcaaaggacagctgatccggcagcaatatcctgcgccataaaggcggctgcaccccttccaacaccacttttacctgaaatcctgccattttcccttcctccttcacccacaaatatccatcaattccggccaataccatacagaaaacaatttcttaatcaattccagcaattcttccgcggatatcacatccggattctgtatccattcactcaatgcggaaaaaacacctgaatagtagatatccataataacatgttttttgttttcacaggatggctccggtaccctttcatcactcatctgaatcacaatttctttaatctgcctgataaaatgagaacggtttctgtcattcagcaaaacagccagtttttctttatgtgactgacacatatctaaaaaactctggaaaaaaacatcgtcaaaatttctttctctgacgttgcccttaaccgcttcaagcagatcatctatcaccattttctccatatattccagaaccatagagcaatcagcgaaatatcgataaaaagttgtacgattgtaaccagcaagcctggcaatctcttttaccgttaccctttcgattggcttctcccgtgccgcagaacaaaaagccatcactattgcctctcttgttgcatccgtcatttcaggctgtttattcatatacctaccgtgagacacatcttgaattattgttgcttgatgtatcatttcccttcttctataataatcataagacatatgttgcatagtttcaatacgaggaggacttcaaaatgaaagaaaacctgctgcaaaaatggtgcgaccaggcttggctgcattgcatttacctgatcggcattatcatgggaaatatactcctgataaaatggccggtatgggaggttccgcaaagacttatatgcctgctagcaattatggtgccgctccatgtatttgaagaaaataccgctcccggcggtttcttctatatgaacaacctgggacagaaatcagacgccccgctagtctacccccagaacagactcaccaatatgttcacaaacctcggcgccgaattcatctttatcctcatgaccgcattcgccgtcagaatagaagctgcttctgttatcgccgtcgtaatatttggcatcggcgaactaatccatcataccatggatggaatccatatgtataaacgctacaaagacaaaggcaaaaaaacgctgtacggaccaggaactattacttcatacatctgcctcttacccttaagcgtttacggatgcctctggctgtcggaaaatccctttacagcatctcaggtcatccttggagttgctattgtactatttataatcatcttcctgatcctcattccctttaccttttccaaaagaattaagagccagaaatatgctttctcaagcgcaggctatttttccaaatatgaataaaaaccaataaaaacctgatgccgcaatcaacacagcatcaggtttttccttcctacaacaaattatgctctctaaggaactgatactgtaaggaatccgcttccatctgcatcagttcaatccgattatgatccggatcatgcgtccagcactgccagttcatatccattccctgtgacacctgggaatcaagcacccagcccgcctttacaatccgatcagcgatttcatgaatatcccccacttccaggcaggtatgagaaaatccgatattctcatccttatactcctgataattcaccccgccataaaacaattcaacgaactgattcccccctgcataaagatacacaatccaaggctcccccgtcttcggattcttcagatcaaatgccttttcaaatcccagcacatcctgataaaactgaattgccttgtccatatccgacacattaaatgccacatgtgccaacccctttacctgttctcccatattttcccctttcttaccttaaactcccggccctgcacaaaactccgccaggatcaaactaatttacgttctacattatacacccttataataacaatttccacttttatctgaacaaccattttgcctcacccattttacaaaatctctttctccccaaccttcccccttcatcaagacaggaggtacatcacaggggactcccttcgcattggggtatccgtctgctcccctccttccctctcctccgtctctggccgcgtgccttatatctctccatgggcatctcaaaaaaagggcgcagtttcttaccgttttatttccataatctgctgcccgcccttagcggcactgtctgacgaccaacgggaggagttcagccgcgttggctgctgattatgaaaataaaatggttagaaactgcgccctttttttgtctgcccatggagagatataaggcacgcggccagagacggaggagagggaaggaggggagcaggcggataccccaatgcgaaggaagtcccctgtgatgtacctcctgtcgccctcccgccggacaacaacgctcttaagaataaaccttaatcattacagactgtgccggaatcagcttaatccgcacatacccatcctcgctttccgtcaccttcttcgtccacagatccttcaccttacagcgctgccccttctccagcccgatttcttccaccggtatcaccacctgccgctcatcagaaagactgtaattaaacgcagccaccacaacagcatcctcatcctttctggcgaaaacatccgcagcgaactctccctgcgcacccgaaacaggccggaagctttctccttttctggcaaccgcattgatttcttcattggtcagcacttccctggcccgttctctggcctccgggatcccgtaatcatcgctggtaagcatcaggcttccgcaaatcacacccgtatgatatctggtccttccttcctccaaagtggtggaatgcttatcataggttttataggtcacgatatgatccggatcattaaagcggtacaggcagtcattcatccaccacagatatgtgatgcagttattcagataagccgattgatccaggctcccgaacgcatcacaggaaatccttctggcatgcccgtagccgtgaggcatgatcggtgcaatggacaggcttataaaaatcgggtagcctgctctcttttcggacaggcattccacaaaatgactcattccgaagttaaaggcctgaacgcctgtggtgatatccttattataaaatacgccttcccggcagccgtgtccgacaaagtccgtctttacactccggaagccccatttgataatattatccgtctcataggaaatataattcatcgtgccgggatgggtgggatccagggaatacagaccgtcaatctgaggcaggatcttcccgtccttatcccgaagcagcagatcctcaaacagataatttccattggtcccgggcacttcctgcttaaactgatgttcatgagtgataaacgggctgtaatacgttccgggctcctgaccgttcgcctccgcataggctacggaatccctcattttattggtaaagctgccccaggccgcatcataattcacatactgttttccatccgagccctgataggtatccttgatggatttcatgaaatcacaggcttccttgtatttttcaaaggtcacctttcccataagggccgcccagctgttccagccgaaaatcacagggccttcccagggcagcgccggtttcaccgcggcgttggcttttccgaaggcctgcagcccatcccgggtatcttcaaaccagcccaggaaaatacgggagctgcacacctgcgtcccgctcagccagccatgctccgcaccgtccaaatccctggtatcctccgtagccacgccggaaatcccccggaattccacaatgctgccgtccttttccgctgccgcctgaaaaccggtcttccagcagtcatgatccacggatcccatgaccagtcctgcatttcccttctccggatgaactactgtgaattcataggacatcctggaatatttcaccggatagtccacgaacttcgcccatttgtcgttgtcaaagggtgctgaaagaaaacggatatctttttccttcatcacaagcaccggttcctccccgcagccgcacagcggagtcatgcaattggtgctgagcacatcttcaccttccgccagcagacggatggttatgtattccggatacacatcaaactgctgaatcagccttatccggcctccgtcctcatggatgaattcttccctgcggcagccgccgatctctgttttttcctcgctgaccctcttcgtatgctgcttcatgtccgttgttttcagacaggtgccatcctgcagcctgacctgtgcatacagattcttaaattcccctcctgaaaaacagatggaaaagcaccctgtctcttcatttaattgtaaaccgtcccaatccatgctcatattcactcccatcccccgctcatgcaggtatattcttttcagtttcaattcttcccttttttgacacgcagtatcgcagactgcgcaggtatcaggctcacatgaatatgcccgtcccggacttccgtttcccgcttgttccacagatccctcaccatatagcattcttccgccgaaagccccagcttctccacgggaatatccatatgccgttcctccgacagactgtaattaaagactccgagcagaatcccgtcttcctccggtctcatgaacacatccgccgcggattcacccctggcaccggaaaccggacggaaggctcctcctttcgcggcagcctcattgacttcctcattcgtgagcaccagacgggaacgccggcaggcttccggaatcccgtaatcatcactggcaagcataagcccgccgcagatgactcccgtattaaatcgggtaatcccttcctccaatgtggtggaatgcttgtcataggttttataagtcacgatatgatccgggtcattaaaccggtacagacagtcattcatccaccacagataggtgatacagttattcagataggccgactgatccaggcttccgaaggaatcacaggaaattctcctggcatgcccgtagccatggggcatgatcggcgcgatggaaaggctgatgaggatgggatagccggctctttcctccgacaggcagcgtacaaaatggctcatcccataattataagcctccacaccggtagtgatatccttattatagaaaacaccctcccggcagccatggcccacaaaatctgtctttaccagcttatacccccattgtatcagctttccggtcacatattccatatattccagcacgccgggatgagtggcgtccagggagtacaggccgtctacaggcggcagtatttcccctttttcatcccttaacatcaaatcccggtacaggtagttgcctcccgttcccggcacctccttttcaaaccagggctccagaacgataaaggggctgaaataggctcccggcttctgattgttcgcctccgcatattccaccgtatccttcatccggttggtaaaccgttcccagcctgcatcatagtcaatatactgcatgccttccgcatcgtggaaggtatcctggatgctcttcatgaagtcgctggcttctttatatttttcataagaaatcaagggcatcagcgccgcatagctgttccatccgaaaggaaccggccctttccacgaaagcgcaggccggatggccgcattgcacctgccgtaaagcttcagcccctcctgccaggagtcaaaactgcctgcgaaaatacgggcgcttttgatttctgttccccgcagataaccatgtctgatgccgttcagatccctggtatcttctgtggcggcaccgcataccgcacggatttccgtttttccgctgttttcattaactgctgccgtaaatcccgttttccagtgatcatggtccaccgatcccagcacaagcccgccctcacagccttcctcatgcagtaccgtgaactcataggacatacgggaatacgcgatcggatattccacaaacttagcccatttgtcattatcaaagggtgcgctgagaaaccgtaaaggcccgtctccgagaatcacctctccctcttcccccgcagggcagaacggcgcaatgtaatttgtctccgcctcactgccgctgcagaatgcggtggaagccgtaaaataatcctcgtagatacagaactcctgcaccagtttccagtcctgatcccccgtatggataaaaaccgccttccggcaggctcccggcagttcctccccttccgattccgacacctcatgtctccataagtccgttgagcgtacaagcctcccgtccttcagccttacctccgtacacatatgcagaagccttccccctgccagctctgcacaaaaggtaccgtcctcctgattcaggagaatacgaattttttcatttcctatattataagccataattaacccccattaaacccaaacttctccgccggcaggaatgctgaatcaggccttgaccgcccccaacatgattcccttgacaaagtatttctgaataaacggataaaccatgataatcggtatggttgccaccatagtagccgccatacggatgctgtccggagttaccgtcataccggatttggcatttgacatctgctgggatacgcttccgccggtctgatactggttcaggatttccaccaggacagactgcatgggcttcaggctctgcgcggaggtatacagatatgcatcaaaccaggaattccactggtttaccgcgacaaacagcccgatagtcatcagaataggttttgacaaaggcaggaccagccggaaaaatacggtcagatccgtcgccccgtctattttggcagcttcaaacagggattccggcatggattccacataggaacggaccagaatcatgttatatacgctcatcatcagcgggaaaataaatacccagaacgtattcagcatgtggattccctttaaaaccatataatagggaaccaggccgccgccgaaatacatggtaaaaataaacagcaggttccagaatttccgccctaccagatctcttctggacagcgcataggcgagcatggaggttaccagcaccgctatgggcgtaccaatcaccgtccttgccacacttactttgatggatgacagaaaggtctttttggtgagtatctccagataactggagaagctcagcttcctgggaaggaaatacagccccccgcgtatggcgtccgtcgcatcattaatggatataataaaaatgttccagaacggatataccgttataatagtaacaatggacagtacaataactttaagaatatccagtatccagtcttctttgcttttatttccgatttttgttttccgcatgcttatcctccccttaaaacagtgccgaatcattcagcttcttggtaatcccgttggcactcagcaccaggataaaggacacaatggacttgaacaatccaacggcggtaccataggaatacattccgtttttcataccatagcggtatgcataggtatcaagtacgtccgaatagttcagtatggagtcattctgcatcaggagctgctgttcaaagccggtattcaggatacctcccacagccaggatgagcaggatacagatagtgggccggattgccggaagggtgatatgtataatcctctgcacccggttggcgccgtccacctccgccgcttcatactgttcctgatcaattcctgaaatggcagccagatagatgatcgcattatagcccataaccttccaggtattggctatcgctatgatccaccaaaaataggggcccttctggaaaaacaggatatcctcgtccgtaaaatgaaagaactgaagaatatcatttaccacaccgtctccggaaaggaaggtgaggaaaatgttcgccgcaataacccaggaaataaaatagggaaggtaggatgcggtctgcacaaatttcttcatacgcatgctgcgcacctcattcaggaaaatcgctataagaatgggcgcagggaaagaaaagagcagcgtcagaaggctggtagccagcgtattgcgcattatcataacaaagtcattctgaaagaaatattcaaaccagtccagccccacaaacggcgctcccagcagatcatggaagtagccttccgttgtgggcgaataattggtgaatgccatgtacaggccggtcatcggcgcataacatataaacaccacccagacaacagccggaagcatcagcagaaacagataccgctgatcccacagcctgttcttcagcggttttttcggcggctttaccgcagcgcttttcgccatattgttaccccctttttttaagaaacgcggtttttataaaccgcgtttcctgttgttctctttgttcagtttacgcgcccttctagttttccgcattccatatagccatacgcgcctggtaattttcattgattttcgcttctacctcttccatgcccgccgcgtcacagtccgctatcatctggttataaatcttatccagctcttcatccgatgccgcgttgatcatcttggggtatgcctgcttgataatatcctgtaccttctgggctttcagggcgacaggatcatttcccgtaggaatcaggttgtcaaattcagcggtatcccagtaggtatttgtcagattcttttccgcccaggttgcggtaatgtcttttctggacatctgcatacggcagggagagccgtccttatgagtggaggcatttcttacaaaccatgtccatctggtaatacctgtctcttctcttgttttttccagattattctgcaggccgtccagtacctcctcattgggaacgtaagtatcgccgtcttttgtccagtccttcccttcaattccccataacagcagatcctggccttcctggctcgcacagtaatcaataaatttcagggcggcatccagattcttgcagttgttggttacggcaatggcatcccagcctaaagaagaacgtccgcccagtgtcgtcttgtctgcgtcgtatccgtccggaaccaccttatatgccagatagtttgcatcctctccgaccgtggaggtcaggctggaattggctgtccatgcattccaataggctcccatatagcctaagatatttcccgttgccagcttctggttgaacagctcatcgttattggacacccattccttttccagaaggccttcctgatgcactccattgatgaaatgcatcgcttccagatatctgggatccctgatatcccagtaaagctgtccatccttctcatagtaagttttcataccgtacatgccgaggattgcgttcttgctgtcctgctcatccgccagggtaagggcaaaggtttcttttccgtcaacctccgggtatttttctttgtactgccggaatatatccatcatctcagaagtggtgaaaggctcgtcgctgtccgccctgtcttttcccaccagctcacacatgatatcgtatctgaggataaatccgtttaccgggtcgggatccattccataccagttggacaaataataattctgcccgtcagtccatctcgttttcttcagtgtatcgccgtacatttccgtcacattgggcatctgatccagataatccgtcagatttaccagtgcccccgcctcaatgtatttatttacaatatcgcttcctctgtccatcaggacgatatccgggtaatcctttcctgcaagcatcagcgccagcttttctgcgggatctcctgtaggatttaccacctcgatattaattccggtgcgtttcatcagttccagggcaacagggtcgtcaaactgcttggaacccgagtttttgtcaaaaaaagtgagtgttggtgtttccccattgtctgctgccgattcggcagtgtctgccgccggtgtttcccctcccccggctgttgtactgctgctgctgttgccgcagccggcaagcatggtaactcccattgccagggtcaaaaacattgctatagcctttttcatagtaccctctccttctctgtataatatgtatacttaataacttttacatgcatataataagtcaatttttacctcttatacatattaaaatattacactttatataaatattgtacatttataagaataaagagggatttttatatcaacattcaacaatttatataaaaatattacaattgcaaatccttctgctctctgataatcggcagtttgatataaatttgtgttccttccccctccttgctgtatacttttaccccataggcctgcccgtactgaagctgaatccggatagacacgtttttcaggccaaagcccctcaccgcattacggatttccgtattgatttcctctacggtttccgcctccatacccacgccgtcgtcggtaatgataaacagcatatgatcctgttcccgccgcagggtaattccgatatgcaaaatcgcagtctcatccttcatggcatgatgtatggcattttccacaagaggctgaaggataagcttaatgatccggcagtccatcagctcttcatccagatcatagtccacctgaatagcctctccgaagcgcaccttctgcagctgaagataattctcaaggaggttcacctcttccctcacactgagaatatttttccctttgttcagggaaatccggtaaaacagggccagatgttccaccatatccataatttccgcgtttccgctgcgcatggccatagaggatatagaggataagacgttataaaggaaatggggattgatctgttcctgcagcaggttcagctccgccgccttccggatcagctctttttcataaatatccttgatgagatgcttcaccataaagctcatatcggaaaagacctctgccagtatcccgatttcatcccgtccgccgtcttctattctttccccgaacaccccgtccttcatcttttcaacggatttggtcagctccttgattctccgggtaatgagaatggagatgacggcggaaaaaacaacggacattatgacagccagaagagcaaataatatgacattttttacggaggtcctgatattcatttccagcatcggaacggaaacaagcgaaagaattttccagccctgagggcttgtgacggagctgaccagcatttccttgccgtcatataccgccgtatcccgtttgttgttccctatttctccttcatagccgtccagtatgtcatagacggagcaccccatgagagacttgtccgtactggacaccacataattttcatcatccagaattatcatttcatcatcgccggacacctcggaaataatcccgagaagatgcctgtcatcgatctccatccgcaggacattccgaaggctcccatagctgtaataatccagggaacgcaccagataaaatacatatttgccgtctttgtttatgcctcccctcataaatacgggctttccgttttcttccctcgcccttttgtaccagccttcctgctcgatttcctcatccaccttgtagataaaataataatcctgggcaatcgtctggttggtcgtatatatggaaaaggtattcacatccgaattgatcgccatcatcgtaccgaaatagcttttcagataataatacagatcctcatagccataattggtaaaatccacggaaatcaaatcctggacctgcttgttcataaaaataagcgaagatgcattttcatagccttccaggaccatgtccatgttattgctggccctggcaaggttttcctccatattgctgtagctctgctccagaagtatgttttccgtattcatataggcataggcgccgaagccgacgatcggcaccatggaggtaatcagaaacccgaagaaaaatttccaccgcagagaaatattttttaaagccctcttgatactgcgcatattccttgtcctcccctcctccgggtgtcctccccggataaccgccggatggcgcgttctgcgggccatccccatgtccgacaaaaaaaagcggctgtttcctccgtatcttctaaagatatggacatgaaacagccgctttggctcaacccagtatttctccccggtactcgttgggagacgccccgaaacgtctggcaaacactgaacagaaataagaactgttttcatatcccaccatccggctgatttcttttaccttcagccttctgtctctgagaagctcgcatgccttacccatccggaattccactatccagtcatttatcgtgatcccttcactctccttaaaaaggcttcttacgtagttagggctcagtccgatatctgctgccagttcctccagacagatggagtctccatagtgagcctccacaaactgcttcacgctgctcaccacgtactctccccgccggttctcctcctgtttcctgtcactcagccttctgatgccggtcaggccgaattccaggcagagcttcctgagcgcttccgcatttaccgcacggtaaatgtcgttcctcagttccgctttgccgggaaaatccgcatcctttttccgtgccgcgcaggcatcataaagctccgacaggaagaaactcatttcctccaggacataaaaacattttctcggtttcttattcagttgatcccaatattccagtaaatacgtttccagcttatccgctttcttttccggacactgggtatgaaggagttccttcatctctctcagtatccggccgtatatctccctgttttcttcctccccctccgtaagcggaatttcctgcttcagttcctcagaactgattacagtgccccccggcacataaaaaagaaactcctgcaaaccttccagatatctgaccgtaccataaagctgttcaaccgaaagcttctccggatagaaaaccacggcggcatgcagccccagctgctccagcctggcgcagatacgctccgcggattccctgtaatccacaaagtaacggaccagaaaataggtacactttttacccccccccccggatggaatacaccacttcagacaggctgttttccacctgttctatcaccgtgtcgtccaatccggcggttgtggtaatcaggccgaaccactcttccttatcccattcacagacatccaggaactgcctgcatgcctctcttccggtttccccgtccttgtcaatcaccctgcacagaagctttttcccatatactctgacggacattttaagaagctcctccttatgcagaagctccctgacacgctccgccgccttccgtatcttttcaaaggaaaaaggcttcaatatataatccacggcctccacctgaagggccgccttggcatattcaaattcatcatagcctgtgagaaaaatgaccttagtggtgcatccgtccgcatacagctgcttcgccagttcgataccgttcataaccggcatatgaatgtccgtgatcataacatcgggcttcagcctcaatgccttatcataaccgtctcttccgcccctcgccgtataaacccggtcaaagccaagctcatcccaggcaatataatctctgagcgtttccagttccagtctttcatcatcaacaagcagcagactatacatttttccccctatctgcgcgttcaggcgcatacataaagccggataccggaaaaaaagaacccggccccctattccaggatatccgatgaaaccaaatggcagtacgtttccccgtcctcgtcatacagctggaattcccctgccacacaaacctccgtcccggcctccggataatccgcaggatcttcggaaccgttttccaggacaaactcgattcccagctggcagcatgctgttgcatccgctatgattacggtaaaatagtgtttgcctccctgatccgggctttcataaacagacatctgcccttccatttttatctttttccccacatattgttcggggtaaatcatcatattataaacttccgaatataccatggtactgctcagctgcgtcagatccacgtccaccgcgtctttgccggatacaccattccccgccgcagtctcagcgggagccgtgttcagcacatccgtatccatgtccgcattaatgatctcctcagcattccattccgtttcctcctgctgcgcagacggctcctgcggtaagaacacttccggtgactcttcctcctttccgcagcctgctgcggcgcagatgaaaaaagcgcaaagggacagacagatacctctttttatcctcattataaaaacctccgtttattctgtttcacagtacaaaaatacaggagtggctgttcctttcctgagaaaggtaagcatacgctcctgaaaggaggttttctcaattattcagtctcaccttacggcttaccggagtatcacaataaaggcagtccggcgcaccggacaaaacctgcataaacagaaaaacagccggaattacggccgcacatgccggaattcccgtaccgagctgcttcagattctgttccgcctgacgaaggcaggcacagatggggcaattccccccggagcagtcatgccccgcttcacggatgaggaagaatgcggaaaaaagagtgaccagaatgagcgtcacacaaagcagtccggaacctgtttttcttattttatccgccattcctgatccctcctttccctttatatcctctgttttacataaacagctctttccattccctgcagtagcccgcaaattcatcatcctgcgggttcacctgcagcacaaaatgaagccttccctgcacggaacagatataaagctctttctcccagcggattcccgtatccgcctccactctctcaagatgcgcgtcaattccgtattttttgcaataatagacctcctgccgcagctttttccggtattcccgggaaacctgaagcttatcattcacaacgatacccgttaccgactgacgtacgtccccggtaagcagcttcgtctttttttcattcaaagtaaaacccatggcttccagatagcttcttaccttgctgcatagtgcggcggcatcaaaatcaccggaaaaggtcatatcatcacaatatctggtataagcgattccccgttcccggcaccagccatccatatatatgtcaaaggggcgcatcaccagattggaaatggccggagatgcgggcgagccctggggcagtctctcattgcagcagcacaggcttgtgagaagcatcgctgccgccgggggaaacagggtttccgggaaagcggcgctgtacacccggggaaaaaggatgctgtcaaaaaaatggctgatatccagcttcagaaccagcctctttcccagatggcaggacgcattcccgcggatgtccgtccccttccgatacgcccgggcgcacggagataccggtctttcatccagcacatgatgcaggatattcctctgcacccctttcagaaggccgcagggaacaagaagcgtccggctgcctccgtctttcttatctattgtcacccggcggtaattcctgctccccctgttgctgagtgtataaaggcaggagagctgtttttcccggctcattttttctcctccggggatcagccggagagacaggataaaatcctggcactgttccctggtacaatatttccaaagcggtgaatttcccataacaggattcctttccggataccgatcttatccccgcgggcagtgaaccaaacaggcatatgacgcctccctgcctgcggcggggtatttgacttacgtatgacggcagcagcgcaataagctgccgggccggaggcccggaagcctggtacagcgttgcatggatatccggccgacacaatacaccgattccgtaagctgcggaaatgtacagccgaaggcggtgtgcacacgtaaagtgtgctgatgtaccttggagcagcttgcggtcgcaggaaacctgcgtccgcgcagcctgttcttcccggcggggactccccgtcaggccggaaaattaattttccgaatatgctgtcagccggatatgttttttattttagcatataatctatgttttttccatcttccggtaattttcctgcttttttattattacaggcaagacgtgacctgtgtttcgtgtcctttaccggccggtctgcaggtgctttatctgtctcctttgtatgcgggccggcatataataagttattaagcagaaaaaggtgatattttatggctcaggtttccaatgaaacagaactggcttccgcactcgccggtaccgattcctccattcagctgacagcggacatatctgttacggctgttctgaaagtccaacgcgacataactctcagcagtctttcccccgatatttatacactgaccaaagcagcctccctttccgataatatgttccgcattgattccggcggttctctgcatctgaacagcatccttctggacggaaacagagaagcccattctgaggaggatacctccaaccgttccctgatacgggtaaacggcggttccctctatcttgaagccgcctccgtactgcgcagcaattattccgctgcggaaggaggcggtgtctatctgcaggcaagcgattccttccccaattatctggaaatgaacggtgattccctgatcacggactgtgtttccaaaacctccggaggggccgccgccatgttctccggatccgtcggggataaaataacgataaccgggcaggcttcccttacagataattacgccgcaaacggcggaggtcttttcctgcgttccctgtccgcatcctatgggagctttcttaccgtagaagaagaaaccgtgatccgggataaccacgcatcctccaccggcggcggtatctgcttttccggctaccgaaacggcggcggcctctcttctcttcttaaaattaccggcaaagccctgatcacggccaatacggcgcatcatggcggcggcatctatttttacagttctaatgaagaagatcttctggatatttccatggacgcagccctcacccggaatacggccgacaataacggcggcgccatatgtatggcagccgttttcgtccccgcccggattaccctggacaatacgtccatcctggaaaaccaggccgggaccggaggcgccctctacctgctttccgattccggctttgctcttacggcagccaactgcactctgagccagaactccgccgtttccggttcatcgggcagcggcggcggactgtggctgcaaaaccgttccgacagccaggaagccctgctttcctttgcttcctgtaaactggagaataacacagcctccgcccagggcggggctctcgctctttttaacggtacttctccctgcacattcacgatggaaggatgccagataacgggaaataacgcctcttctcacggcgggggcctgctgcttggaatgaatggaaacggacagctgcagcttacagaaagcagttttaccggtaatgaggccgggagcagcggaggcgctgtttattacagcaacggaagcggcgttggtacgatatccgccggttccgtaagctttacaggaaaccaggcgggttatgaaggcggagcgctccgtattgcatccggatccggcactctcagcacgacattggatgactgtcaaatcacaggaaatactgcgctcaataacagcggcggcgggatatggataggcggggccgacaacaatctccgtctcgtcaaccagactctgacggcagataatactgcccgtatcggcaatgggggcggcatctactgtaacacggaaaatggttcgctcactctggacggtaccgcagaaatccgcgggaatcaggccgggacggaggaaagtgacttcggcggacacggcggcgggatatgcgccgtaccctgtcatataacgctggatgcgggaagcagcattcatgataacaaagcccttcagtacggcggcggcatcagcctggctgagaattccgtgcttgatgtacacggtgcacggatcctctccaactccgccggaaagcagggcggcgggatctggaaccatggcggaagcaccgtccatatggaggccggggatatttccctgaatacggctgctgtgggaggcggcctttataacgatatcggttcccaggtttatatgacgcaggccgctgcctttgggcttaccggttttaataccgcctcttcccatgcacccggagtttataataacggggaattctatacagaaggacagagggatatctccaacggcttttacattgaggatcgggatgccgtcgttttcctggagggcgccctcacttccggttccattcttcagctggataattccggatatgtttcccccaacccggaagggaatcccattgtggtgggagaagggaccgcagactatccgatactgacagacagtgatgcgcaggctttcctgaagcctctccaggattttgacggatgggaagtccggctgagtgatgaccgaacccagatctggctcgttcccaccctctataccatacagtatgaaaatctggaaggaagcagccatacgaacccggaaagttatacagtcaccacaccggatatccatctgactcctcccgccccaaggccgggatatcgttttaccggctggtatgattccccggtaaacggcaggaaggtcacggtaattccccagggaagtaccggggattggatcctttatgcccgatgggctcccgacaggcccaaaaagccccgcctgcccaaccggatctgcaggcccggggacccgccatgctgcgacagccgccaaacgggcaggagaaccttcgcttctctgcctgcatatccgtttggctcaccgcctgctgaaacaggaaaacagggccccccggagattttattctccgaaaagccctgctgtttcttttttccatatatctgtcattccgccgtttcagctcctacagcatggtactgcgcagctcttccgggctttttgcgctcagataggagggggcaatatcaaatacggtcctgcagccgctctggccttcctgtcccagacggtaagccgccctggcgaaagccacgaggacagaagaggtaaaggcgggattggaatccagcttcaggctgtattcaatcacattgccgtattcctcttcccaaccggtttttccgctgcggattacaaagccgccgtgaggaatgccgctgtgatccctttccatttcctcttcactgataaagtgcaccgtggtgtcatagtcggcaaaataattcggcatggtcttgatttcttcttcgatacgcgctttatccgcgccttcctcaagcaccacaaagcattctctcgtatgcttctgtctggtcgtcagatccggattttctcccgccctgacactgtccagcgcttccttcaccgggatggtatactgcctggcatcggccacaccttcaattctgcggacagcatcggaatgcccctggctgacgcccttcccccagaaggtgtaatcctttccctgaggaaggatggcgttggcatacagtcggttcagagaaaacattcccggatcccagccgcaggatatgattcccacttttccgctctttttcgcttccgcatccacagcggcgaaatgctccggtatcttcgcatgggtatcaaaactgtctatcacatggaaataccctgcaaattccggggtctgtacgggtaaatccgtggcgctgccgccgcagaggatcaacacgtcgattttatccttccagtgaaacgcctcttctattttacagaccggaaccccctccgtctgaatggataccgtcttcggatcacgccttgtaaagaccgccgccagttccatgtccgggttctgcctgatggcgcattccacacccctgcccagattgccgtatcccaggataccaattcttatactcatcttcatcctcctagtttcagtcctatactttgtttttcgttgttaagtatatcgcttttcaggcaggatgccaatactttttccgatgtttttgccgtcggcagcttatctttcgtacatggtgaggtaggctttggtgttgtccaccatggtgtcgaagaggcactttgcttcatccaggccgatttccatattaggatccatgcagaaggcctggaaagccagatccagatttctggtgacggcagcctccaccgtcagctcctggacgccgcagaccctgcttaccagcggatagatactttccggaagcgcccctgcaaaaacaggctttacggaatccgcgcagaaatgggcatttgtttccaccaccgcacctagcggcagattgggtatctgtccatagttcggaatattcacattggtaaccagatcacgcaggcccagcagggaacgcatctgctgcacgccttcttcgcccgtcgtgttaatgaccatctcctcttcgcccttgtaaagtctttcgcttcttgccaggcggtttttcagatcctcttttctccaggccacgggagtgagcttaaagccccaggaatgagcggtatccgggttcttcagataccaggagccgggacagaattctgcgagatgacgatctcccgccgccgctatggctccgtatttcaggaagagatccagcttcaccatttccagggaatcgaaaaacttgttcatccagttttcatctgtcttctctccgaagcctgtatccttgtatttcagggcaaattcccggtataccgggaacagatcgatattcttatactgcgctgaggtcagccatgtaaaatgattgacccccaccacattgacacggatatcctctctctgcgcatctttgatctgcaggatgtcctccagtgcctttccgagaagcttctgggttccgaaaacctcatgacagcagccaaaagccttgatttccgggaaggtacgatacagcgtcttcacacatacggtcatgggattggtataattaataacccaggcctcagggcagtattctttaatcgcacctgcaatttcttcaaacatgggtaccacgcgcagcgcccggatcagccccccggggcctgttgtatccccaaccgactggtaaatgccgtatttttccggagcgtgtacatcgctttccatttcgtcaaaggtgccgggaatgatggaaataaccacgaaatccgcaccctgcagggcttcccctatggtttccaccgccttgtaatcccatggagacttgcagtccttaagttcctttaccttatttccaatcacttcatttcttttggcggcttccagatcaatatcatacagataaacacttccgctcatgtcatccgccgcagccagatcactcatcagcccccatgcccatccgcgggaaccgccccctatgtaggcaatcttaagatcctctgctttaccgtttacatacctcatactgttcctccttcagcctgctttccgcagcatttcttatatcactatactaacacgcaagaaataagaataccgtaaaaaaaatgcttttccgcatccaaaaccgttcaaatattgctatttattagcgatttgtctataataggactgaagtacaaaaataacagggcatcggctcctttgctgttccggcgaaaggacggcgcgctgcttttcagataacgacggaggctatgaaaccctatgcttcacaccgcatttaccccatatgaagaatttctggtggaatatgtccggaaaccgggaagaaatgatatgaaggtacagcattatcatgatacctatgaattctatctgcagatggccggcgagcgcaccctgattctcaacgatatctgctataccctccggccgggagatctgtatattttaaagccctttgaaatccattataccgaaagccgcggttcggattattatgaacgttatgtcatcaaccttccggcttcttttctttatacccttctgacagaaggggaaacaaggctccttctggataagctggaatcctgcgtcctgcacctttctccggaacaggctgcggaggcactgggctgctttcagagagcggagcagttccgccggaaaaccggatttctggcaggcaagctgctgtgttcctcaatcttccagcttcttatgttcctgacggagctgacggaaaaagcgggactgcctgatattctggagggaaaaagcattcagccggaaatcgtaaaagcgatccactacattaacaggaattatcaggaaaacctttccctggaaggcgccgccgaactggtccacttaagccgctatcatttctgccgcctctttcatgaagccacaggtgccacttttctggaatatctgtataatgtacggctggccaaggtgcatcagctccttctcaccaccacgctgccgctgggagatatcgcagccaaatgcggttttgcctcaaccgcccatctctcccgggttttccgggaagcctacgggatgtctccccgaagcttccggaagacggctttatccggttaatgccgcctgttatgggaaaataaccagactctcaatggacttttccatatcgatcacataaacaaccttgttatcctttttataaatatccttttctatccagataccggagggttccatttcctccgggctctcgattttatccttatctgttgcaaatatggcatagggctcaccggaaaaatggattcccatccgatactttccccattccgtaatgagcaccatatccctgttctttccctctgccttctcttcttccagctccacgaccggaacaatatttcccttgtaattgcagactcccgcaaaacaatcgggcagacagggaattaaagaaagctgcatctgaatgcataactccgtaatatatggaatttccacagcatagcttttattttttcccggaatgcagagaagctctttgccagtataggcttccattgatatcctccctctcgtatctgttgataactgtttccgtatccagagcggcgcatattttgccgtttcccatgatactgcagccgctgatccctgtttttttccggaaatccaggccgaataagggcggcagcggctttaccacgatacgcttctgttcgtacatggaatccaccagaatacagccttccttttcatttcccttcatataaatgacgatggcatcctccggcgtttccccgtccagacgataaaaccggtgcagatcaatcagagggagcatcctgtcttcataaagaatataatcccttccgttaatgttttctcttttttccctgctgctctcccaatccatgaactggaaaacatgacgggccggcatggaaaaacggtagcttcccaccttaaaccggatgcactccatagtagccagggacaggggaaccacaatggtaaaggttgtccctctgccgaattccgtatggatataaaggtttcctcccacaccctccaggatattttttaccacatcaagcccgacgcctcttcccgaatattccgtcacctgctcatttgtggtaaagcccgggctgaaaatcagttcctgtatttcctggctgttatattcctcctcaggtctggtaaaaagccccttttctctcgcccgttcccgtatttttaattcgtcaatcccttttccgtcgtcgctgagggacaaccgcagctctcctacggtgttctccgcggtaaaggtaatcctgccttttctgctctttcccgccgcttccctctcctggggggattcaatgccgtgatccaccgcattgcggatgatatgcatcagagcctcggaaacatactccaccacacttttatccgcctccagatcctcacagtgaagaatcagttccgcttctttttcctgatccctgcagatatcccttaaaatgcggcgcagcttgggcacgattttatttacgggaaccagacgcatttccatcacggttctttccatctcactgatcagccggttgatctgatgtgcggtcccctctttgatatcctccaggccatgcttctccagctccgtatccagcgtaagcatatgaagcatcagctcccctgacagattctgcaggcggtccagacgatcggaacgcacattgaaaaattccgcttccctgttttccccggaattccctttatcctccggcttctgtttttcctgctgcgcgccttcctccgcagccgacggctgatcgtcctgcaaaatactgcattccgcgacaaaaagtcccttcttcagactttccagcacctcatccctgtgctcggattcaaaccggataaacaccccgttttcactgataaaaccgctgccctccccggatttgtccaaatccccgggccaggcttccacacacgtacacagatttcctatctgcctgaccagcataaaggccctgatattctccatcttgcagccgttttcaaaaaagatgcgcactaccgtacccttttttccggccagcgcttccgggactgccgccggcggacgtatcggctctttttccgtttcttctgttttttcttcttcttccgccccgtccggttcctcttctcctgctttattcagataggcatctgttctttcttctatttccgccgtaccggaaggctgatactcctcctgagacatccttcccagttccgcttctatgtgatcggaggctgcgaacaacagatcaaaaagctccggttccgccttttctatttttccgtaggtttctctgtaataaccaaaaagatcctcaagcttgtgggccatggaagacaattcctgaagccccatcatcgcggaagaactctttatggtgtgcatgatgcggaaaatactgtgaatatcttcttccgcaaatgcattctttttttctgcttccaataataccgcgcttaactgcccggtcagctgtctggtttccagaaggtaaacctccagcatatcttcggcatccgcatcaaaatatcccattattttctccgcctgctaattattttcaaaccagatactgcagttttttccggaacgctttcctctgtacagcgccttgtccgcgcagttgatgctctcctcaatcccgtcctgctctcgataggtatgaagtcccagggtcaggctgcacttgaactgtacattgttataaaaaaacgggaactgttccacttctttccgaattccttcgctgataccaaaggcttcatccctggtcacgtcaaacaatatgataaggaattcctcaccgccccagcggaccaccttatgtttgcggcagcttccctccagaatattggcaatgcagacaagagccatatcacctgcatcatggccgtatgtatcatttattttcttaaagtcatcaatgtcggcaagaatgagtacattctgggtctgctccctgttgtgatccttgatgtcatccaccagatcccccaccacataccggcggttatacagtcctgtcaggccgtccctgaaagccatataattcaatttttccatgttggaacgaagttcacggttctgacggttcagctcatccttctgctgtttcagctggaggtgggcgcgtactctggacaaaagctctcccctgacaaagggcttcttaatatagtcacaggccccttttgaaaaaccttttaccacatcgtcatccttatccttggatgtgaggaacagaatcgaagctccattctgatccaccgccttcagcctgtcaaaaagcgtatacccgtcagcatcaggcagcaccacatccagcagtatgagatccggctggtactgcttcaccatggcctccgcctcttctcctgtatgggcctccgtgataaaaatattctcttcctttaaggatgctttgatctgttcacagatgagcagactgtcgtccacaataagcacaatatgtccgtttcgagtttccataactaacctccgtattttctacagaaccaccgtttcctgtctcaccgttctgacttccagtttaccgtccccggcgaagaacaaaatcgtcctgccataatttttccccgtattttcggccacgagccttatgccttccttttccagggcaagcttcacagccgcaacattctgctcccctatttcccactgccgggaagccgtctcaaacattttcgccccgcccgctattttagcggttatccttttcctggatgcaccggccctctccatctcacgtatcagctctttcaccccttcatccgcaaatttataaggattctccctgctgaccgccgactcttttcccggaaggacgatatgggccatgcctgcaatttttttatctctgtcatacatacagactcccacacaggagcccagggcataagaaataagtatctgctggtttacggcagtttttccttccccgattcctactgaaattttatccatgatgtcactccctgagcctttgaagcatcatttccagcgcttccggctccggcaggaacaatatccggccggaaaaagcctttcctcccatgcggaaaatgttatctatcaccagaatgtcctcactcaccctcgaataatgggccacagggacactcagaatagcgagccccatatcgatgctcatacttggcaccgtcacttccattttcagatccaacaccccggaaagggcgcagatataagaaccgcacataatattcccaagctcacatatgagcgaacgctccatttcatccaggctcagaagatttctctcctcttcccccaaaaccgtgtccagaacctccctggtaaaggtctcgtccagaaggaataaaaacaatccgttcagttcccccctgacccccacaataattcctgtcatcaactcttccgcctccggcaggagagaacagcagtcctgatatttcataatctgcagtcccggcacttcgatatccacaggctccatcagcatatgggagagagacgttaccgcatttcctgtaccgatattgcccagctccctcaaaaaatccctggatatttcatctaaatccgaatattgattcatagcctccccttttcagccggttttttagaattcaaactgctccaccatttccttcagtacctgagcctgggcggacagctcttcactcgccgccgcactctcctcagaggtggcggaattcccctgtacaatttcagaaatcagctctatgctcttccgaatctgggcaagggcatccgactgctgcacgcagacctcagaaatttcctcaaccatactgtttaccttctgcgcacccgtcaccgattcctttaaggcctctgccgtagcttccgcagattctattcccacatccaccgcttccgaattcttatcaatcagttccgccgtcagctgggatgctgaggtcgtcttcgcagccagcctgcgtatttcaccggccactacggaaaaacctctgccggcctctccggcccttgccgcttccacggaagcattcaaagccagtatattggtctggaacgcaatatcctcaatttccttaacaatcttattgatctccctggaatttgtcttcacatgccccacggcctgtgtcagttcctgcatctttttgtcgctgtccctgagactgtttcccaccgtgttggaaagcttgctggattctaccgcgttctgcgcattatccctgaccctgtctccgatctcgttgatactcacagccagttcttccactgagccggcctgttctgccgcgccccgcgccagtgtctgggctccgttggccacctgttccgcgcctcctgatacaagctcggcactgctgcctatctgctgcagggattccctcaaaaggctggaaatttcattcatcgcttctcccagcgccacaaaatcccctttgaattccacctccgaatgataattcagcttacccttacccagggcagacagtccttttttgacctctgtcacgtataagttaagggcttctgtggtattcctgatatcctccgccagctggcccagctcattttgtgaaaaataagaaagcttggtagtaagccggccgttagcaatgtcattggctgccttcttcacctcatttacggggcgtatcacgctcctggttatgaggatgcatatgataatagtaaagccaatgctgacagcggctaaaagaagaaggaatataatcatccgttcattcattttctttccttcagccagacgccccaccgcatcctgtgcagacaaatcgataaccttcgtgagcgtatcctttacctcattaaacttgggtgcatactgactgacatataagttaagggcctcctcatcttttccctgatccctgagacccagaaccttcgtccttatcacattcagctcctcatactggacctccagctcggaaaccttttccgctccgcttatgtaaccagtagtcagctgcttaagctgtttttctatttccgcaacattctgactggtcttttccagatactcctcttcatctaccacatcctccgttgaaatgaggagtgtgacattcttccccaccgactgcaggttggcaatcatccacaacgaactctccacattagcgaagggttcgtcatacagaagctgtgtccgttcgttcatggaattaatattggctatcacggtaataatcgtgacgatatataagaatataataatagcgaatgctgctaccagttttccgcctattttcatatcctcaaactttttcttcatccttctgcttcctttcatcagaggcggggcttgccgcacctgcgcattttattctttcagctctctaacgcattccggacgattctccggaattcatccggcctgaaaggctttacaataaaatccttagcccccagcatcactgcctgctggatcatctgctcctgccctacggctgaacacattacgattctggactgcggatcctccctctgaatttcttccagcacctcaatacccgatattcccggcatagtgatatccagaagcacaagatccggcttatatatcgcatacatctccagagccttctccccgtcgcacgcctcgattatatccgtatatccgcattcctgcagatttttgcatatcaccttcctcatgaacatggcatcatccaccaccattattttcttccccatatgtgctccttcaccaaatccttccttattcctttttcttcctgtaaacagccggatataccggttccaaatttgtttcctttatcgtcagcagctccgcgtgcccgatcagcagatatcccccttttttaagtgaatcctcaagatttcttatgagtctgttcctggatattctgtcaaaatatatcattacattccggcacagaatgatatcaaatctctccgacgccggcatgggttccataagattgcgtctctggaaacggacacaggactttaattcctcatccacccggaaggttctgccgctcgtgtccccgcagtacttccttctccattccggaggaaggccttccagctcctttaccggatattccccgtcccgggccttgtccaggaccttcccggagatatcggtagccagaattctggcccgtaatgtcacattctgtatccgcttatattcctccagggtcatgcccagagtatagcattcttcccctgtggaacaccccgcacaccagatatccagagtgccggacaccgaatgccccagcagctccggcaggattgcatcctgaagccgttcaaagtgatccgcctccctgtaaaaataggtataattggtggtgagatgattgaccatctctcccgccatttcaccgctccgatcctgatgtaccatatccagatatccggcaaaagaatccaaaccgtaacgctccagaatcttggacatacggcattcgatcaacaccttttttttctccagattgataccgtattcatcacgcatatactgcacaatatcggagaattccttatccttaagcctaatcaatttttctctcccaaaccccgggtatgataccttccagctcttcccgatccacgttttcttctcctaatgactgcgctccgattcccagaagccgctctcctgccctgatgataatcccgcagggagcttcttccacggttccttcccgataaaaaaccaccagctcatttccataaacggaaaggcccaggatattatcctccgcctccggaacaggccagacctccggcctcgtcagaatcgtttctatctggtctttctctatataaacctttttgccgcctgtatccgccgtaatatattccatcaggcttcctccttccgccagggccggagttcatccacatccagcagataggccagcaccttccgcccatcctccagctgcgtttcgtgggcagcacacaaataccggttcttcttcactcgcaccggatccatcaattcccacacctgcccttcgctgatatcccggaaacccagaatttccgctgccgggacaccaagcttttcctctttgcagtttatgagaatacaatatttgtttttgctgttttttccgctttccgcccacagatctataaattcagtctccggttctctttcttccggcagggaattttcaatcactttgtctacaaatgggaggggaataaggaaaaagaaattttccaggacaaaaaaaatgcagcggtccttctgttccctcatatcttccgccttttctttttaattgaattgtattctaataatactttatcggagggaaaaactcaagtgcagatgtgaaatatggagtaaaaaaataaatttttttgataatttttgtgtaatgttgaaagattatgggatatgttggaagaaaaggttataatgcggggcaggcattataaccttttgggtttagataatatgcagttggattaataggatttttgcgtttaatgaatgtatttttatggtttcctttgaggttccggcgggtattgttcctaaggatattattgtgtcgatggtgtctttatggaatgctgttgttgcctggctgccggatttcagggttatctgcagctggccttcttcttccgttcggcagcttagcctcagctttaattccctctctgcacagctgccgcatgtaaaactatagcagacatattcatccggctttaaaacaagccccagccgttcccagccacaatcaaaagcaaacttcttttcctgtgcctcatacatctcccggatttccatcgcagtatccttccggtacagcttatcatcctccgggtttccgtttcctttccaggaaataccttcccccgggaccgaatcaaaatctacggcctgtaccgtaaaaggcggtctgcggaacacgtgggcggttacctccggatgcagttcacaattttcataccggatattttgcagataggcctccagtatctgctgcgccctttcgaatccgggatgagggcctttctccagatatccgagaatttcctcatacccctccggtacttttatggaacagggtgaattggtgcagtccattttcttccagggccacagattatatcctatccccagcgcacttgccagcggatacaatgcggcgtaccagggattgatattttctccggtttcccccatccacaatggaacatccagcttgtctgcggcttcgataaagggttccaggcaggctctgtccggcatttctgcataacggtgaaagtgcagaaccatattatcatcatattttttatggaagatacgcacatcggcagcccaatgggcaccttcgaaggacagcatatgcacggtatcctcttttctgatttccgcagtcacagcttcataaaaatgttccagttcaggaatcagataatcatagtccccgtttccggcatcggcaggagcaataggttcattgaggatatcatagcctcccaccacctcccgttctctgtagcgcccggccagcttccgccataatgcacatgctttgtctctgcagtccttatctatgaacaatctgggaacgttatccacagagtcatcgatattcgacccggtttgtccaccgggcgctccatgcagatccaaaaaagcatacattccggcttcttcacaccaggtaaggcatcgatccagtaatacaaacccttcttctttccaatggatacccggtccgtcttccataaaaagacggtaactgaacggaatccgaacagaattgtatcccgattccgccatagccaggatatcctctctgcgtatgtaattttcccggtattccttccagaaatactctgcgaagtcccggccggtcagttcctccaccgctttttcaatacgggaaggccggtcaaaacgctctccataagctttccacatatagccttcctgcaaaagccagttgcccagtccccatccggtcagcagaatctcttctcccctgccgttcactatttttttcccttttgtatgtaaaaacccttctattgccattttcttcctttctcagcccttcactgcaccgattgtaattccctgtaccagatatttctgcagaaacggatagacaacgagaatgggcaggattcccatgaccgctatcgccattttaattcccgtagacggaagctggctggtatcgatattcattccctggcttgcactgctcattaaaaattgagtgtccagcagcatccggttcagcagcacctgtatgctgtacaaggtatctttgttaatataatacagaccgttcagccagtcattccaataacccagccccacaagcagggcaagcgtggatataataggtttcgccataggcacgactatccgcagcagaataccgccttctccggatccgtctattcttgccgcatcgatcacttcctcaggaatattgcccgtaaaataggttctcatcataatcacattaaaagcgcccattaaaagattgggaacaatcaatgcccatatggtgtttttaatatggaagttctgtgtccacataatataagacggcaccagacctccattaaacagcatggtaaaaaacagaaaaaaagcgatgatattcttccccggcagatcctttctggaaagcggataggcgaataaagttgtaaaaataagatttactatagttcccacaattgtaaccagagccgaaatcccatatccccgaagaagctgggtggaatccaccagaatatatttataggcggaaaaatccagcttggacggaagaaaggagtaaccgttaacaatcagggcgtgttcttcgttcagagacgaggaaaacagaaggataagcggcagcatacaaaaaataacgagaagaaccataatcccgttcgccagtatttgaaatgttttatttctttcgaccatagtctctcctctcctaaaaaagtgcactttcttcgttctgtcttctcacagcccaatttgccaacatcacaagaaggaagcctaccaacgactgataaagccctgctgccgcagacataccgatattattggtttccatcagccctctgtatacataggtatcaatggtattggttacgtcaatcaacggcccgctgttcataggcacctgataaaacaggccgaaatcggagtaaaaaatcttggataccgacatcagcgttaaaatacaaatggtaggggcaagggcaggcagtgtaatatagcggattctctgccagcggctcgctccgtccacaactgccgcttcataatatgaagaatcaattcccatcagtgttgcatagtacagcacacagttatagccgatatttttccaaaggttcaccaggataagaatcaaaggccaccaggcaggattggaataccaggagattttatctttccccatattctgaagtgtgtggttcacaaatccgtattccgtacttaaaaagccatatacaatataactcaccaccacaatagaaaccaaaaagggaagcagtatcaatgtctggtatgtcttcctggcccggaccgctttgatttccgacagcaggacagccacggtaatagccgccgccgttcccagtataataaacgccagattatagcagatggtattcctggttatgatccacgcatccttggttttaaacaggaatataaagtttttcagcccgttccattcgcttccgaaaatgcctttttgaaaattatattttttgaatgctaccacagttcccgccatgggcaggtaattatttattatcaggtaaatgcctcccggcagcagcatcagatataaagggaggtatcgcctccaatttatgcttctcttcctattcaccggattccctcctactgaaacggaaagggaagaagcgtgcttgtccacaccccttcccttccggtcctttttctatccgtttatgattactgctgtgccgcccaggcatccagctgcgcctgtttttcagcaataatcgtatcaatgcccgcatccttcagttcctgtaccatcttgggaaccgcttcctccggattcagggaaccgcagtccaatgcatttttatattttgccgttacattattgcaggccgtaatttcattgagcacatcggaattatcccatacaaaaccaaatgccttactcagtttggcattattattaaattcctccgtctgtttccaaatatccgcaccgtcgacctcccagggaatcgtgatcaattcattgggccatacccaggctacactgctgtaggtggtattggaagcatccacgccttccggataggtcagcacgcctctttcactgtcaatcaggaagttttcgccttctatcccgttaatcaggatattgctcagatccggattgctgtaaatttcatttagtacctgcatagctctctccggcttctcgctgttgtgcgcaatataccaggtattcattccggatgcagacgtacgataggtctccaccagttccacaacggtaatgtccttgcctactttcctgctccattccgcttcaattcccggtttggtattgcagaaatagctgaagccctttcctgctgccatcagttcataggcattctgagtatttgtagccgcatcaggcataatatatcccatctgtgcccagtcatacctgcgctgaacgatttctttgaaggtatctgtttcgaaccagtcaaccaccgtcatttccgaatcatccagacagttctccagccagccgaaatcaccgcccaggtcatccctggtaatattgtaataacccataccgccgttatcggaaaccaaaggataactgtccggatatttttccttaactgccgcaaacagaccttccagatccttttctgtcttaatagaagaaatatcatagccggaggcttccagcatatccgttctcattgccagaccgaagccttccgctttgtccttgttgttaggtacaccgtaaatctggcctcctatgctcacacagttccagtctgtatccggcacaacagataaaatatccttgccatattccggaagcaaatcatccagtgctaaaatctgccccgtattcgccgctgttatcgtagaaaatgcgaaattagggaacagatccagtttttctccggaagaaagcatcagattcacttcctcagcaaaactgccatagcttaaacgtaccagttcaattctggtattatatttggccattgtaatttcagaagccgcttccgctaccttttcacagctttccgatgtggcatctcccacacatacaatcttacagacatactcttcctgcccggacaaatccgatacgtctgcactctgtgccgtactgctttcggcgctttctttcatgccggcagcttcagtacctgtatccgtacccacaggttccttattccctccacagcctattagtgccgcagaaaccattgccgccgtaagcagacctgcaatccattttcttttcattgcattccctcccttgtttttgatgcctttactatatcatggtcaatcctttgcttccgcctcattcgtaacctgttattgtcataattattacttctttgcaggatttgccgtctattgtcaaaaaagtgactttttgctgttgcatttgttcactcctcctgttttttcctttcatccgtcgggctgacaccgaaagtctttctgtagacctgggagaaatgggaaaaattactatagcctaccttcagcgccactatacttaccggaagctgagagctgataagaagcgccctggccattttcatcttttcacggacaataaactctttaagggagattccttccacttttttaaacagacgggaaacataattggggttcataaatacctgtaccgcgatatcctccctgcggatgtcactgtccagatggtggtatatatattctttaatagcctctacctggcctcccgctcttcctgcgtcctcttcctcctctgcaaaataagaggttacgatttttaaaaagacctgcatgttctgcagcgtttcataggcgtgcagggcggtctgccgctgctgttcctccggaaatatatcctcccaggatgtatccgtcttttcttctgtcagacagataatcctgtaaaaatcattataaaacttctgaaggctctccgcgttcaatgcttccgcatctgccagttcctgcagataccgacatgcttcttcataaaccgctttccccatcccccggacaagcagtgtttcccaggttctgaaatccggctggaggatttggtccgctttggtttcttttttctcctcttcctcatagatccccggcttccgggccacattatccttattcttatgcctgatgacctctaatttccccggcatcgtccggaacattccggtaccactcacatataacgcctgttcacagcagaaaaaacgggaagcagtattaaaaaaacgttccagctgtcttcttgtttcttccttgtccggctgttttccatcttctccatatacaagaaatataaattcctcatggctcaggcagccgatatagaccttcctgttccattcctgaaacagttcttccaggatattcgcacaggaataacgaaataaatccctttcccatggcgcattattccaacgcagtatctggcataatataagaaaacacggactggaatcgcagatatgccgccccattttctgcatatcctccagcagcttacaatacctctccccattttccggttcctgataccattccctgaaaagctgatccgttatccggtcacgctcctcaaaaagtgtttttccataggaataaaatttctgctgctcccgtttttcctggatcctctgcttggcccgcagaatggcattcccgatatcttcatatctggcaggctgcagaatatagtcaaagcttcccagctgcatagctgtcctggcataaacaaaatctgcatgggcggtcagaaagatacattccacctccataccctgatcctgcgtccacttcagcagggaaagtccattttctcccggcatttctatatcgcaaagcataatgtccaccttattaagcagaagaatcccctttgcttccaccgcattgtaagccttccaaaccttgtccactccaagattttcccaggatacctcagacagaattccctccaccacgtgtatctgatcatcaatcaccaatactgtcatagtttctttcctcccttataaattaactgtcggccgccttgcttcttcaaagggtataaaaatatccacacaggccccattcatattgctgtatacaaaactgcacggcttttgataaacaagagaaaaacgctgctccacattgttgattcccatatgttctcccggcatcctcttttcaggatcattcaaaatctccagaacctcttcaggaaagccttcgccattatccattatagtgatattcacaaacttttcttctccatccaggaacagccttgccttaatcaatatctgcatggatccctccccgctcttttcatacttgaaggaattctccacaaaggtcagcaaagacatgggcggtatcccgaactgcataagctgcggactcacatcctcctcatattccggtggcctggcactgctcatctgctgcagctttacataagaacgaacgctgtccagttctttttccaaaggtacaatcatatcatgatcctttaaaaccgcccttaaatattcggacagagtcaatatcatttcctgcatctgcgtatatttccgggcagcagtcatagcatacaaatttttcatacagttcaggaaaaaatggggacgtatctgaatctgataatactgcagctctgtctgctgtgcctgaatcaagcgaacatatgccagaattttcaattccttgattcgatccatcatggcattaaaggtggattccatttttttatattccttaacctggtttcttacacaaaggcgggattccagcccatcatcaccgatttgttccatcgtttccaccatctgttccaacggattaaggaagtcacgtttcagcatccggtagcatcttaacaacaggataacaaaaaagacagacagaagaagcatgatgagaggcagggattccatactccaaattccccgatatggttccaccagcatcagacagcaattaaggatttctgagtagctcattaccacaaactggtctcttctgctgccggtcaggtaggaggttttcccttcctgaacacggattcccaattccttcatctgctcctgataagaaaggatttcctcattttcttcaaacacaagataactgttttcacttcctatttcctctatagtggatacatttcccacatcaataatacagctgctgtaaacgccgcccagccccatgattttcagaaaatagtatttttcccctatttgctgtacccgccagtcggtaatggctccgtcccctttttccttcacaagctggttgagataggtttttatattctccttttcatcgtaggaaacattcttacggaatggaccgttggtaatattgcttttaggactgataatgcagaaggccgatatgctgtcaatagtcttcatgacagattcgaatttttcctgaagctgttggacctgcagatagctgtccacgtagctcaagggatagcgcagggcattaaaaccaccgtcattagcaatcatatccgacatgaaatattctacattcttcaaatcttcctccaggaaggattcaaacatggtgagccgcgtttgattgttttcagttaaacgctgtctgtatatggtattgctgtaaacattcagcccaaacataaagagaaaaaaaggaatcagaaacagcatggatattttcaggagagctgttttggcggtaattgaacgattcatgaattatcctcttttcttatgatagcagtggaaagaacagacctcctgtgggggcaggtatggttatctggcatgcggatcgtttagtatttgtattatatcgcatatatcagatgatggattttccagtttattgtaacataaatgtgtagtaaggatgtataaaaaacaagctggaatatccgaggtgaatattccagctgatatattgattctttgacagattataattcatgatggagcaatcatggatttacttagaccttggaagtgtttgtattggaggataatactttttcttttaaagcctcctgcatactgatacaatatttataaaagattccttgacggatatttctaattgctctgctatatcttcaagatttactttttccatctgcgaaggagatggaaatactatatcctctttttcacaagtatataaataaccagcaaggcaatcaatcgccatggccaatgcttcttccaaagtttcaccacacgtggaaagccagttgagatctgggaaaactacagtataacctgtttcttctttaaaaaaacatgcaggatatgcagataccatttatatgcctccttcagtctgttaaaacaaccgtaattatttcaggccggcctgtttcatacatcagtcctttaagtccagcaccttcctcacgcttcgataaattttcaaaccatcccttttcccaaatcgttttaatgtattgagataaataattttacgttccggctgctcgcttatgatattctgaacttcctccgctgtttctgcaaactcggtctccgcaagggcattatggattaatgatttcatacggttacgctccttatatgcggataattcagcttcaatactcaccctttttaaacgctgtctgacatgatatgtccgttcgttcctttcctgagcttcatgaatacatttctcgatcgtggaatcaagaatgaccatatgcttctcatccgaacaatacctccaaaagtcggcaactcccttaaatccctgatctttactgacgattgcggccttacctgtgtatccgtttccaaaaattctgcccaattcagatgctatatagaaatcaagtgaattcttgcctgccctgaataatttatatcctctgcatacgcagccggaagcaaatatatccgacatgaagccggattccgccttgtcggagcattcgctgtaaaatatggttaccgtatcttccggaaggagaaaggaagcgcctctcaggcccgcgcttcctgtattttcaaaatctatcatgaattgcatacgccgccctcactcatattttatatgatggttttcctatatgtatatagtctacttcagagccaggcggttgtcattgaattcaaaattcaagaaatagcattttcattcatgaaaagaaagtatgtccaaatacgtttctgtctgttgttcaaacatttcatgagcgtatatctgttgtcttcctctttgtttccaatgatcagacgatctatcggtacctggagcagggcactcaaagcatatagattatcaacggatgggatattaataccatcaaaccagcggtaaatcgtctgtatacaggaaagcgacagatattgctggatatcttttattgtataacccttgtttttaattaactgctttaactgtttaccggttttcactttatcaattacaggatattgcggcatttaagattccttcctttatatgttcttccgttcattaatgcatattgtactcatattccctcatcgctaatctgatatatttctttttaatatatcaaactgcagattttatttatcgatattttatcatattattgactattacaaaagcatcttttattgttataaaatatacaattctacacattatctttaacagaatttaaaataataaaataaatttactgagaatgacttgatatttacctcacattattattcataaaagtgtgatctatctcacatttttataaataataatatgaaaaaggccttgacagctttcacttccccgtatccacagagaaatccaagccgccaaagcctttaaaatcaattctattattccatgccgggcatacacatataaccccttctatttattatccaatatcgcctgatgcagccacacaaacaactcatcatacttcaaatgtctgccctcaaatttagtaatcccggtatgcagggcaagcgatatctcctgtccttcaaaacaaatcatttctccgttcattccgctgattccctctgccagttcctgagcataagcgatatcccggctggccgtcagaagcacaaactcatccccgccaatccggaaaataatatcctcatctcccgcacatttttccattctcctgacagtctcaagtatagcgagatcccctgccttatatgaaatttcattaatcggcaccagtccctttatatcacagcagataaaatagcagtccttccgttccaaaaacaaatcatacagttctgaaatatccacaggcttcctttgcttcatataagcatctcctttttcaaacagctgcagcagacgcggaaaaatatcggtaaaccttttctcttttcggaaaacggacggactgcatccccaaacctgttgaaaagctctggtaaatgcctcatgtgactggtagctgtaacgaagggcaatatccaggacagtggcttccggataccgtaccagttccctggcagccttcgtcatacgcctttttattacatattccttcacaccgtaatggtatacattcctgaacagcttctccagtcctgatttggaacagaaacaatttcttgccacactttccgcagtaatcgtttcacaaaggttcaactcaatataagataatgcatctgcaagcagctccatattgttcatagaggcctcctaatctacagctagcggtaccgttattaacagaataacagctttggccctgaaatgcttgatatttcggataaatgcttgacacatcctattttgcttcacgctccttctcatactgcgaaggcgtaacccctacatacatcttaaatgtcctcctgaatgtcacatcattggtaaacccgcattttaaagcaatttcctgcacattcatattcttcttttccataagggaaatggcgcattctatccttctggatgccacatatttctggaaggtacagccgaactgctccttgaaatatttcccgaaataggtagcggtataatgcattacccgggccgtttcattaagggaaaggttggcgtcggtcagatgatcctccacatattgccggatcatctgatttctggcgtagtataccgggttctctttcgccacgcactgttccatcagacggactgttttcaggcggaaggtctgcaggtagctgtcaagacctgcaaagctttccggttccagcaattcaatctggggcgtcagcttaccctggcttttctctccgaacagttccagcagcatggcattcagtttgtggattcctgcgaaataagcttccttgtgcagaaaacgggtattaaaattatacagcaggattgattgataggcttcaaacaacgtttcggcattcagctcttccaccgccctctccatgctctttcttttgtcttccggtatttcaaaggatgaacagtttaaatcccgttcctctatgcgatcctcctccagacggatgacctttttttcaggataaaagaaatggtattccagggcccttaccgcctggttataggcggatagaatatgcagaatatcttcatgtacgttactcataccaagggcagcatctttgtaacccgaatcatcaaaggtctgggagagaaggtcggcaatctcttccataagactttcctcgccatagctcagcacccagatatagtatttatcctcttccacaaaaacagaatggatctggggatagacggcaaggcaggaatctatttccttgatgtattgtcctgattccgggctatgtttgagcgccagacaacggtagagggagtactgacgcatggtgtttacatattttacctcgttggcctgcggtttattagaacgtagaagggtatggagaatatactgttcgatgaggggattttgttcgaagactgtcacttccaggcgctttttctgagagtccagctcttccagtgccttttcaatgatctggtactcattaacgctgccctccggatcctcctccaccagcatattcatgatatgttccagcggctggtagctgtatttggccatccgggaagccacaaccacaatcagagccagcagcaccaggtatcccataaccagccattccgtaaaaacagtaaaatccctgtacagaaaattattatccagaatctgtatgatgccgatatccataccggctttggtatattgggaaaggtatactccaagctcttcgctgtaccggtactccttgtctgatgtcttcagaatttccgccgaatctcccggaagaagaggtccgttatctttaccccaggaataaataactttctgcccatccgtaaggtaaaaacatgaggttccgtcatccatgaaattctcaatataagcacagattttatcatagggtacaaagaaaagaatattcacctcccctgaatacgaattctgcaggggtatagtctgcagcataaagaaacccgtcacacgcttcccatttttcatcaggcttgcgttgtggcagatagttttctggttattctgatccagcatggctccggataaaaatgcagtatccccgcattgaacctgataaatgcttacgtattccttccagttcacttttccgatactgctgattccaaaaccgccaaggctgtagtaaatatagatggattccaccatgctgtcgttgatttcagtcagcgaaagtgtgctggcataatcagaaatgtccgacgcggttatgttccgggccataagctccggtatcctctgcatatatttcagccgggttacccagggtgtcatggaatattgggccgatgatttaatcaggttatccatcagatttttcagctcactgtccacattctccgttatggaattttcaaaattcagcacccgttcccgtgtcatgtgataataaagaaaagaaaacagacaggaaattactgtgagaataaccaccggtatgcagacataagaaacaaacatcttatgctttgtctgatattttttacccttcctcatgctccactcccccgctgcagtaataaggctgcgcaagcttactcccggcccgctccctgcgggaacaaatccgggtctttcagttctgccaggccgatttgttcaaatacccacacaggctcttcatatgctgctccattataccacatcatccacttatcccctacgcgcaggacaaaaggcttatatacggctacagaatcccaatctccctctgtgggacatatgaggggattatcaggatgcttttcccagcccgtaatcccgtccgctgatctggcaagtcctacctgtgccctttcctcatggagatggcccacataaaacatatagaaccagcctttttctttgataacgcagggagccaccaccttatgctgttcccacaaatgagctttatccccggataacacagggttactctcatatttttcccaatggattccgtcagggctggaagcatacccgatggcgtcaggttcatgattgcagccggcggcataccacattttatagagctgatcctcctcatcgaataacacatgagggcacataatggcctgcagctcccatgcctgatccggtaccatgaccggttcctgcctgcgttcccagtggattccgtcagagcttaccgcaaggccgatcaccgaccggccatcctccagatagggcttcatctgaccggaataccacatcatatactgtccattatggtgaataaccgcaggacggttgatttcatccgcctcccaggaagacccaggcaacggctccaatactacacacggattctcccaatggatgccgtccgtactttccgtgtagccgactgcccttttcggccgccaggaaaaccacattttaaataccggcatcccctcttttccttcttccagcaataacgaaacgtcaaagcaggttccgtagtctccgccgaataccggatttttcccatattttttccagcctccggcagttccgtattgatagtatttccggttttcctcacaatcataaaaggcgatgcgctctgcgctgctcattccttccggtgctttgatattcatataagtttatcctttctgttttgaattatgtaattcctcactattttactgcgccgataagtacacccttttcgaaatatttttgtataaaggggtacagaatcatgatggggaaacaggcgatgacaataacggcatatttcatctgctcgttcatcagcaccgcatccagccccattcctgaggcctgtacctcactggtaatcaggatactccgaagatacagctgtatgggctgcagcttttcattagataaaaaaatcaatggtgcgaaataactgttccagtagcccacaccataaaacagaatcagtacggaaatgatgggtttggataaggggataaaaatgcgcgtcattaccgtccattccgatcctccgtctattttcactgcttccgccatctcttccggaagggattcaaaaaaggaacgggttataatcaggttataggcactgataatatagggaagcacaatagcccatctggtattatacagatgcattttctgcaccaggatatacagaggcaccagaccgccgctgataaacatcgtcagcgtcatcagcagagacagctgtctgcgcaggaagaaacgttttctggacagaacaaaggctgttgttgctgtcagtgtcacgctggcggccgcccccactacagtataccagagggtattggcaaacgaacgcagtactgtggcattgtccagaatcatgcggtaggccttcagggaaaaacccttcggcagaagatacacatccctcgccagcacatgggaaggctcactgaaggacatgctcaccacataaatgaccggatataaagtaaaaataataattaatatagtcgctatgataatcggaatgtccgatggtataaatctttcttttctgttcatggtttatccctcctccgccggatttcagtttctgtcttttctcatatctgtctcccggtctttctgtcctacgcatcagaatatactggtttccgttgtttttttcgccaggaaattggctcccagtaaaatcactacattgatcatggaattggcaagccctacggcggaagcaaaactgtactgggcgttcagaagccctttacggtatacgtaggtggaaaaaatatcggcggtggaataggtggccgaattatacatgaggattaccttttcatagccaatgttcagcatgtttcccatgttcagaatcagaagcagaatgatggtgggagcaatggaaggcagggttatgtagatcagttttttccagcggcccgcgccgtcaagagacgcagattcgtacatctcctggtctattcccgcgattgccgccacatagataatggaattccatccgaattcctgccagacaccggatcccacatacagggtccggaacgcttccggaaggttaaaataatttttaggctgcacgccgaaattggcaagcagctgtgtgagcacaccgccgttggatgacagcagatctttcaggattcccaccactaccaccacagaaacaaagtggggaagataagcggccgtctgagccactctgcggattccactgtgtttcagttcatttaagagcagggcgaaggctatgggtacggggaaggaccacagcagctgctcaatgctgagcaggaacgtatttttaactaagcgtccgaaataaacggattccaccagttccctgaaatgcttaagccccgcccagggacttccccatatccctttggatatgttgtaatctttaaaagccatcaatatcccatacatgggtccataacaaaagatggcaaaatacagcacgcccggaagaatgatcagcaaaagcatccaatcccgcctgatatttttctgtaatgtacgcagcgctttcatataacttcctctccggtcactgttcatgttttccccgtgctgcctgaagtttccatctgctccgccttcccctcccggcctttctgagctgtaccggctgctgtacgacaaggattcctgtaagggccgtataaatacgccggtccttaggctgcgtattttgcagccttagtaccgctgcgtagttatccgagcgaaagcgcgccctgtaaggaaccttgtcgtacagcagccggtacagttcagaaaggccgggagaggaaggcggggcagacggaaacttcaggcagcacggggaaaacatgaacagtaaccctctccggagggcgcccggaagcgccctcattctttttactgtcctacaatttcctgatatctctggtactgtgcagatttaatatcaataatatcctgcatccccatgctgttggctgtttccacatatttgtcaaagttatccagtgattccgtgccgataacaaaggctgtgaacatttcatccagataagtggaaagatcaggccatatgctggtataaacttcggattcctctgccgttcccagcatttccgggaagggattctccatatttccataggcctctttacatgcggtttccactttggttccttcgaatattttcatgaaggcttcgccggaatcgttgataaaataagtaggccatgcaccgatacttctcaatgcggaaaaagctgaggtataggtttcattattggttatcagatcggtgaaccggatttccccggattcatcatattcgtaggacatgccttcgatcccatagttgtaaagcatcaggccgtcctggcttgcatatacgtaatcaatccactggactgcagcttccgggttctcgcaggcggaggtaacaccatagtaatgccaggtaaggcctcttttagtcatacgggccgtgccgttttcatctgcctggataaccggcatgaattcatagtcacagtcaggattgcttgtccttgccaaatcatcggaggatgccatattatcggcagggtcatggcacacaatccccaccttgtcctcggttatattctgggtgagaagagtaccgtccagatcgtcggatatcagtccttccgaatagcatttattcaggaatgccagcatttctttatattgatcctctacggcagcataatgtactttaccgctgtcatcggtataccataaggaattggtatcgtagccgaagcctgtcatcaggtaatacagctgtttgatgccgtttttggttgccatgggaatttcatcattgggatttccgtttccgttggcatcctgttccttgaaggctgccagcacatcgtaaagctcgtctactgttttcggcatttccagccccaggttatccagccagtcctgtctgatataaaggtaatcgggaacataatcgttaatatccccccaccagcctgccagagcataaatatttccgtcagaagaggtacacatggcttccagcgccggatatttttcaaataatgcctttatgttaggagcatattcttcaattaaatcattcagaggaatcagcacgccattgctggaatacgtatccacacccacattagaatcaaagggcggtatttccaccatatcgggcagtccctccatggaggccagtctggtctgaaggacggtttccacatcgctgctgtacgtatcccattcaatatgaataccggtacggttttcgatttccttctggactgccgttccgtcattgtagctgacaccggcacaccaggtatcatttcccatataggtaagtgtaacggaacccggatcgcagatgggaagcttaagccctcctaaatcatatacggttcctgttgcattgattgcagtattatcggccggatctgattgttcctgtgctcctccttcctccgatacggcttctgttttgttttccgccggaacggaatcagccgttgaagacgtgtttccggaagagcttccgcagcctgccagcatggaaccggctaaaactgctgtaagtaagcatgacagtaatttcttttgcataatgtaactccctttcctgattcgttttactataagcccggccggtcttatatcgtggttgtgttgctgattcaagtatatgttgtttttgcacaattataaagaaacaaaatcagctttcttatgcattattcatgcccagaaagctgattttgtatgaaatcattgattttgttttttactttttaggaattgttcagagtcctgtcttcacctgtttatcctgctataaaagcatccccattcctttcttaaatgcactcttccgtgaatgcatctgccggatcctttcccttgtctcgcccctgggcctcatcttcttttggggcatggctttataaagctccactatcaataagcgcaaatcctcttccggatactcttttatcacttcttttatttccgataccagcatactattaccattcctcttcgtcgtaagacggatactgttcaggatttgcccccttaaccacagtcgtttcactgccttccatgtgcccggggattatacgcttaaccattacatggaaatgccacgaatcaccaaaatcatatatgtattcaaagcttaagccttcatataaagtaagttccgccaatacaacctcatcagccgtcagttccatatccctacattccggtgcataatacttttgtctcagggtcccggaaccaaattgaaaataatacaaatgatcactgtcaaagtctacactttttaatatctcataatgaagatcttccaatgtatgctgatccccggtttttatttcccttaccgcggaaccaacccttatttgaaactcaatggaatgctctcccgtttctgctgatttctccaaaatacgttggaattttaaatccgtatctgtcgtttcctccggtattatttcaaaaattaaatctgaaagcgagtcatcatccgggtaattccagaaatcctcgtcaatctcatccatcagcgctgtcagacaggctccttcttccgttttgtaaatcgcattcactagaaatttattttccggatctacaggccctttgtccagccattcaatagtaattaagcggaataaggcacagagacgaagctgcggagaataaaatttcccccatatttgagggtcttttacataagaatatgtaacaggctcattaacttttgttttcctgagcttttcataaaattcggaacttcctgcgctgaaagaaaaatttctgaaagcgtcctcgtatcccccaagccatacccacatcataagggcatacttttcgataggatataattcataaaaagaagaatattttgggcctttttcataaatcagccccgcgcccttctttgataccagccgcaggatgtccaaatatacggaaaagaatacaaagaaatcaattactgtataatattcctgtgtccttcctgccttcttatatctctcttttacgatatggaaacggctgttcagttcaaaacaatctttttttccaaaatggcccgtcgccttcgaaatcattacttcgtttgtttctatgtaatccagaaaaatctgatattccttttccagttcctctgccgcattctgaaattgattcatctctcatcctctgctcttatctgttccccgttcggaacccatatattttcttcaaccgctcccagatctcataagctgccggacatacttccaccgcatcgagcacactgtacaggctctccagtctgtatggctggtccgtgtagggatatctgctgcaattatccggtttattctctccaagcatgcatgtgccatcctctttcaggaagtcacagggcatatgtttcgtctggtactcccacggcatcgcaccacgttccagaaaaaattcaataaactgttccctggtaagctttaaccactccgcatccttttccaaatccgactccgggatggtaccagggtacattttacagcaatttctgcacttactgcagtcatatccgtcaaatatttctttgtgcagctccaggaactgcctgtccagcgtttcttcctctgcatggtttttcaagtaagaacgaaagcgaatattttcattctccttccgttttgcctgcccggcaacttcttccggttttatcatgactggcacctatcctttcatgttatctttatatattttgatactaatgctcttatcataataaatcaacaattattagcaaaaaccgataaatatttcgttccatctaaacaaacgtccctgcggacagcaagttaattacatacacagatgcgtatctccggcttgctgccacagagattcaataatcgtcggaaacgcggaaggccgctctaccagctgcgtactccttttatatggataaaacgggctttttcatatatataagaatccaaaggcctcatatatacatcatacgtatgggctgctacataaatatgcccccggctcacgtgaacaatcaccggactgtggtaaaatccactgccgtctcccaactggacaatgtcccccggctctgcttcggcttcctctgtctccactgcatacggcccgacagactgatttcccacaagaaaattatagaggaattccactcccgtccagcttggcgtcctgtcccggccgctgttatagtaccagccctttacgggcgtgtaattcattactccgcttcccgcataaatgcattgtgatgcaaaattagtgcagtcccctcccatattctcaaaatccagatatctgggatttctgtccagcgcccacttctttgcataaagcaacgcatcattccgatgataacctgtttccttcagcatattttgctgcctgccgtttttttatttaatatctatattatggcaggttccggcaatgcgttaatgaataggtaaccctctgtataaaaggattggaaacggcaactccttaccactataaaaaatactttctcatcggttcaattccatccggatccgttccagattttcttctacaggccttcctccgtccaggactaactgacggcagtccagctgcttctgccattgatcgtgcagtgcccttgaccgcatattcacatcaccggtatcgtaagcagcggcccattcaagaaaatcctgatgctgtttgtacatatcgccgccggggaggatccgatctccgaaccgttccgcctcccgcgtttttatacgggcaatgcggatgtccacgtccgttaccagacgaacggcaagatcaaacatggggatgagaggatctccccagcccgtaacagaaccggaaataaccacttttttgtgctcttttatgtcctctttcatcagccggacccgttctccgctttctcgcatttgagtaaaccgcggatttgtcggaagccagagataatcatcggcatccataaaataatagcccgattcgcgggaaaaggcatcacccagggtagatgtgccggaaccggagcctccgtatatgtggattacatttatctgcatggttttcctcctcttgtgatatgtgacaattatatcagatccacagaacggaatcatccccggaataaaaatactgatagaaaacaggacacgccaggagctgaaaaacttatgttcatcagcgcccggcgtagaaatcaccgactatatatcaggaatacctatcctataccccttgctttttccggtactccataaacagcttccagtcatcccttcccatataatgggtgccgggacggaggtggaaaccgacacggccttcatggaatacatctcccgtggacggaaggcgatccgccgcaagcccctgctgccccagcatttcatagacaggcgtcactgcctgaccggtcaggaattccgacaaaggatccgcccattcatcatctacagccccggctaaatacaagtgcctgggcgcagcaagagccgccgtaaaatgctggtcaaagggaagttcctcctccctgttctgccactttttaaagttgccgcagaaccagtaagggaaattccggcacaaatccgccacattttccccttcttttccccggaaaagagcggctcctccggctccggattcacaggctatgacaagggaaaaacgctcgtccatcgctccgcacagcagcgccgccttccccagacgggaatggcccactaccgcaacgcgccccgcatcaatcgtttcctcctgaaccagataatccatgatacggctcagtccccaggcccatacgcccagcttcccccagctgtcataggcattccccgggaacaggctgccggggccattctgaaaaccgtcattctgatccggcgcaatatcctggtaagataccctggcaaccgcaaaaccattatccgtgatttcttccacgatttccgaagaggacaacgggaaaaaactcaggtacagaaataccggcggcttttcaatattcttgggaaccgtcagctggaagggataggaaacgtatcccctgccggaacgaatccgcacatccacagtgcgcatacgggcctttccgccaaaggcattctcttcttccgatacggtttcccattctgtttcccagccggtttccggtatatatccatagcattctttctgaagaatgtcccggatttccttccggcgggtttcccacagctgcggggtgtccacgggcgtgttgtctgaaaggcgcagcagttccggaatatggcgcttttcaagttcttttgttattacttcttttcccataacatttctcctttttataaagatttttacgatttcaccatgaaagaatagttcattttcagatctccggctactgtcgctcctatcgtttgttccagaaaatcaaagtatccgtttgtacccatattctttgtccacgtttctatggatttctctaatctcagcagacaaataacaggcacctgaaagtaggcgcgcaaatcagaaggtgaagtaaaatcccagtaccctgacgcggccgctttgacttcatcatttgtaaagggatcaaaactcatcaaaagtcctgtgacaaaagcttcattttcaggtgtacggtatccgtttaaatcatattccgtatctgtcagatatccgtctatcagcagcaggcatacatggattgcttcaatcgccactcttccgtttcttttctcgttttcccggtgcagcttaagcaggttcccttccatgggggcaaaaattatgttgtagtcgtcttcttttcccctttcgattttcccgaattctttggccatcatattggaaatcttatcaaatttgtagcggtttaattgttttttcatgtggggtctcctttttctctcttttctttcattttatttatctgacccattgtatttcagctttatgtattccgctacatcatcgatttccgggaacagagatgctttatttacggaaaactgatccagctcatgcagcagattttccttatttccgacgataaaaatcagctttttgcctgattcattccgatatcggaggctgcggagactgtttccttccccgtttccgtctcccaggccgcacaggatgaaggatccgtcctgcttgatgattctgcggttattccgcagcggcataataaaaacatggctgagaagatccttctttttgatacggggctcgaatccgggattctttgatttcacctctcccgccagcttcgcggcaaggcttatgtattccgggtcttcctcttcaggaattccattgatacatgactcatacagtttcgtccgaaaggaagcgtcaaaaaccggaagggcagctaaaatagcagccgtatcgctttttgcatatttcatggcggcaatctgtgtccgcaggacgatgacctcccccacatcctcgggactgctgcagcaggcgaaatacagggctaccaggggattttccgtgatgtcaagcagtctggttggcagaccgtaatgctgcatttccaccagatagtccagatgggactggcactgtgcaaaatctgaggcacagcgtatgatcagctcctggtacatcctgttttcattctcctgccaaccggggcttctcttgatgctggggagcagggcataggaaagcctggaatggccgcggaagtacaggatacggccggtatcctgctgtttcatgaaggagatgtcttttacgtagccgcttactgaatcgattaattcgagttcacagcgttctgcatcgtagatgatgttgttcttttcatgaaggtccatttgctttggagcggattcttcattgatgtcgttgtatttttctatccattcaggagccaaacagttcagaatggctatgaggtattctttctttttttcccgcttgggagtgttggtgctggtgtaggggaggaagatccagtataccagggcctcttcttcgagaggagacagatttctgtcctggtttccggctatggcttccagatactcctgcgtgatttctatgttttctgaggtcatgcagcttttggcgtagagcttatacaggttggagccctggctgttcaggcgggagtagtagctgccttttcccagggccttcagtacgtagctgcagtccacacagccttcttccaaaagcttttttccgaatatgtggtagaatgcacgggaaatgtagggggatgtgcgggcgtagatggttaactggcgggcatcggaatgcagagattctttgtatttttccatggtggggtgcctctttggtgtggagtgaatggggtaaagggtggaaccgtatgggattatttttaaggggatatgacctcgattatttgaagcagcttttttcttgggctgataattatccaacagcttatttttagtcttgcaggaatgggaattgagcctgcaaaaaggctttgtattccggcttctgtgtatgagtaaactgttctttgatcgttttttctatccattgcagttttgacgctgaattgtcttcatatttttggataattattttatgatctctggcggcggttagtattgcctcgtatgcatcggggatgtattcgcaggaaactggaggcatactgtattcagaagtataagcatatggtatgtcctgctgcttttttatatccggggatggggctatggtataaatatagccggatatgcctttgtaggtttcttctgctgcgttgggatagtattcttccaggcgcaggataccctccccggtaaacccgtagctggcccacttgtgataggggccttcgggaaatttcccggaacgtttgccatagagttctatggcgtttgataggtatgggagggtgttttcccgttttgcggagaggtatagcagcggtgttccgtggttggatgtgtgtggggttaatatgtggagatcttttatgggagatgcatggtagtacatggggtggcctccgttatgtatgatagggaatgcaatatatcattaactgcacagttaggagcttcttttcttgattccgtgagaatcttagacgctcctgcaaggtgacatttatgggaaactgagaaatccccagcatgttatttgaacgatttatgtatactcaaacactgcttgccgatattttaagtgaagatgtatggggtctgatagaaacaccattccatgtatcagctattccgatatcttccggagtaacattttgataatgtcctttcattccttcaatttccacattggtattttcgtcaattgtaattatgacgtgaagcggctcttcgtaaagaatcatgtcttttaggtacggatacttgtcatgaacctctttgctataattatacatttccttcacaccatgccaaatatatgatgcagaatttaatgaatagtaatatattccattaatcaatttgacgtcatccccatggtcattaccatttatacaaaacagaatttttctgctcaaagaattacgttcttccaatattttgcgtacagcttctctattcacaatacctcttgaatgatttccaaccataaagtcattacataagctttgatgtgagcatataatataaaaatagttttcatcagcaatttcactttttaaccattctatttgctcctttggaatatatggacttttgtcgcttgaagccgttaaattcgcattacattccggagtgcaatcgctctctgttctgatatggtttggatccaaaaaaataaactttatattatcccgaatgattgaatagtatccttctttcaaaccgaagaaactaagaactttttcagatgagctaaaatccgtattatggttccatatactatgataacaggatatgcctgcgtcgataaataaatccaatattctgtggttttcttttgttggattgcataaatctcccaattcaacagcgaattcggccttttttcgcttacactcttgtattaattcgtaaatacgtctgtcaccatcaggaataacatcataatgtaagtctgtaaaaacacaaaatttcataagagcatttcctctcgcatatcatatttgtcagtctgatttgaatgttgcttactattttcaatactaatattcctgtgtttaccagtcaaacattgcagcatattattaattcttataaggcattattactagaacactagataatacaccattttcacatcctgtgcataagaaattccaacaaaaatccgattatcatgcgctcttccatgttattaaagaagttataagaggctgaaaagataaatatttttttaacctaattaaatctatacattttctttcattttacgactttctataatattttcaataatttctaagtaatcttcatacataagagatttttttgtatcaccaaaataatttttcaacaattcccagaacaaataaacaaatattataatacacaaaaaattattaatagcatctgatgggaaaaaacgatctaacataattgtaacccatgtaattatcagtggcaataatacagctgaatagctgccttcaattcttccggaagcccttatctgatattttaaatgtcgtttaaatgctaccagacttttagtggttatacatgaatatttctgattaacatatccagaccattcatcataattactataattattttcacctataatcataagttttttctttccaatttttttcctacaggcatttagataaatataatattctttatcttcattaaaatcatatgcatattcattttttttctttttcaagcttatgcccctcttcgtacctccgacgataataattcatcgttctatagtctattatatccttcatatgatccacaaaagccggctcgtctatcacgtccttcaaatcatccctcagcgccagcataaaaccttccttattaacaaaaaagccactcttggatccctccagataattaatcggatttttcctcgcttcgctgagatatctctctcttttccagtttctgaacccctttgttcctttatcccgatccatatccctccaatttccgtctctttcataaaaagacctgtagttgagatatacatcctcttccgtaattcccattttaacctgtccgtcattgaaaaatgccaaaagtatgggcatcttataagatttgaacattgaggttgtttccaattcatgcagaaattcttttcccggtccctggaaaagcttccattccttatctgtcagctggtctaaatcacctaaaaaatcaaggtaatgattaaatggattctcatttgaggttttcatacataattgatatatttcctcatccatataagtaaaaagatccatacgcgcaggaacctttcctccaagtaattccttaatacgaaaatactccccttgaatacgctccctgcgtgtttcttttctgtttgccatttctttaaagaggtcaatgagcctcatatcaaaatcaacaacgcagtccagaggaaaatcaaagtctttttgttcctttttctccgcagcttccctggaatagggttctccgctaagaagaaaaggagcatttcccgccttctcataattcccaataaaatcaagaaccgtcagatactctttaccagccgctttccgcagtcccctgcccagctgctgcagaaaaaccacaggtgattccgtagggcggagaaacataaccatatccagtgaaggaatatccacaccttcgttaaacatatccactgaaaaaataacactaatttcccctttttccagcttctctattgcagctgttctatcctctgaaaagttcccgtccgaatcactgtataccgcacaggccggtatattccttgcacaaaattcctctgccattttttctgcatgcaccctggaacagcaaaagcccagcgcacgccgtgaaccatattttttataattcttatatatcagatcacatctttctttaacaatcagcttgatatccagatccttctgctggtattttcccctgacgacaggaagcccggaataatccactccatcatagattccataataacgaaacggcaccagcattcctttattaatagcatccttcaaggtgattttaaaagggacattgtaatcacatatctcataaatattccgtccgtccattctgtccggggtcgctgtaagtcctaatagaaactgatacttaaaataactgattattttcatatagctgtcatttaccgcatgatgaaattcatcaaccacgatataatcaaaataatcctgtgggaaaaattcttcattcaagtattcttcttttccaagactgcttaccgatgcgaagataatcggcctatccgtatctttccgagccttattaaaaaatccctgttcatcctgagggcggatccttctgaagctctcagctgcttgtttcagaatttcttctctatgggctacaaacaatactttattaaatccaaccgaatcaaatgcggcaagataggttttaccgatacctgtcgccgcatgaatcaaagctttttggtcaccttcctcacggcttttctttaacgcatacagcgcatctatctgagcatcccggggaaatacaggcatcagctgtgtctgaacctccgtcatattattctgataccgttccatatctttctgcaaggccggacgcttccagctccttgcatactcttccaatacttcatccgttacctcaacggaacgacagcaaaaaaggtcctcaaactcctgataaaacctgttataattttgttcatccttctttctggtgaatcgatagttccattcaatgcctctcgtaagagcactgcgggatatattggatgaacccacataaatctcactgtcatccgcataatggaatatgtatgctttcggatgaaaagaacggttcttttcccgatagagatgaatgcagattctgtcatcaagctcgtatttaagaagggtaagggcgcttggctgtgtaattcccaggtaatttcctgtcagaagacggatattaacacctctgtccagcgcggatttcagagcaggcaataaaagccgaactcctgattccatcagaaaagatacgatgatatcaatgctttcagcactgtttatactcatttccagataggtcagcagatggttgcccgggatgtcaccgcccatactggcaccgcacgccgaaccctccatccatgtattatccttagacgcgtttagtaaatacagcttttctttattagaattatattcatccatttttcttcatctcttcccgggcgtatatctgtactaatccatttttccttcagttcaaatacatttgtttcctgtaatattttctggagttttccttcttccaggtcaataaaatacctgccatttctcattccttcaaaatccccgtatttaaaggatgcatataggataccttctttttttaatgcacaggcaagctttttcaggatatctttgagttcataataggtggaatggagaattgaggagcatgcccagataccatcgtattcttctgcggcattcagttcctggaaaagcatttgttttacagggactcctgtgtattcagatgcgattcggcataattcttcggatccatcgatggcatctgtatgatatccatgagccaggaaatatttcgtatctcttcctgaaccgcagccgaaatccaggatgtgtgcctgtggaggtaaaaaggaaaggaatttgttttgtatgggggcaaaatccagggattgggtggaactgctgaactggggggcattctggttgtagtagttcagggtttgagaagcatatttatcattcattttttcgatacctttccacaattaagagaactacccggttaaattgcaatatcttttttacgctccaaataagaatttcatagcaatttatgaattcacctctcaagatatttttttaactgctttaattgcttttctgtcattttttcagcataatgcattccgttatacgtcggatgtaaaactggatactgatcttttgtttttagtatgtaattatttgtaatcagccatgtaatcatcgcatataactcttcttttgaaaaagagcttaatttaccaaactgagagatcatgtttaattttgcatccagcattctctttgtaatctcgccgtgtagtacatcaacaagcatggtagttccataataacggatattactaacattctgtaaggccgaaagaatagtatataccgtttcattcaaatcccatcctctgtactctatagcgggcaagctacctttttttattactatattatctgacactacagtatccggttttttcttgttattctgataataagtcgtcttgattttgatattttccttcttttcctttactggttcattcagatccggttcatatcccatcatatcataatactgttttttactaattacattgttgcagcctgtcccatcctttttatagtttgtacatcctaagaaataatccttgtccttagctttttttacaatcagatagccatctcgacaacaatcacatttcataattgagaatttaccagctgcatattcattagtcatgaatccacatatttctggctcatttgtgcagataaatagccgcaaaccatatgaatttttgtatcttagctgtaaagggtagccacaaagcggacaatattttcgccctattgttttgggttcttcttcattccatttaccatgaagtacaatatttttataatccttcttcaattccaacaaaaattctgatggattctgctccggtgcaataaaataaacacgattttttgttctggtcattgcaacatagaaaaggcggcgttcctccgcgtaatcaatggaacggtcaccctttattacaaatgacaaaaccggatcatcctcgattttcgatgggaacccataggtttcatttctaccgtttacaataattacttcatcgtatcccaatcccttagaagaatgtgctgtcataaatgtgatattcaattccggatatttaacactttttatcttacttccccgattgatatattcaaataatcctgacttttccaaatgatccccatcaaagccaaagcgtccaagcagtaaaattgactctgatttcctgccctcattcttagcatagctgattatttgctccaaggcagtctcaaccgcatgtgcaatagcataattaacaccactcctacgatttccatccttacctttatatgtactgtcatatgtataaataataacaggctcattaatctgctttggagattctaatcttttggttatctgttctgtatttttttgtataaagttacccgctatatcaatgacttcctgcgaattacgatacgtctttacaatctttaagagcttggcataccccatcttctcttcaaactttgtaaataatgttatatctgacccactaaaagcatatattgattgccagtcgtctcccaccgcaataattttcgcatcggtcacttctgccaaagcctttgttaaatcaaaccgctgcctcgatatatcctgatattcatctacaataacatatttaaaagccagcttttgcttcatttctttcacttcacgaaggattctggccgattcatttatcatatcctcaaaatctactgcttttttctccctaagatacctctcatactctaaaaaacaatcattacatatatcgagaaacaatctggttctgacattctgtgtcgaatgatacattcgattaaaatcatctaccgtatacccatttaccttgaaattagatataaatctgcaaattaaattaatcaatttgcgtacataacgattttcttcccctgcaacaagcatttccattacttctttatttggacggggctttatttcaaatccattttcctctaactgttcacgcaaatgatgtaataacggctttccatcattatatctggaaaaagtataaattaaaattgttccgtgctgacggtgtaataatactttttcgttaactgctttcttataagcttctacctctttttcactaaatctgtcattatcaccattttctgttattccaaaatgttcaatgtaagcaacctttccattctgtttaattaggaaatccggggtatatggttttctggcatataggatatgatactgataaaccggttcgtattcataatcgatattatttagatacaaaaagttagcaatctccacctcctgatgagagcgtagaacttcatttaaaattgtaacggatttctttgtttttctatctattacctcacgtttaaaatcttctaaatcactacgcattgtagaaaaattagattttgcaatctggttaaagaaagcattcaggtcatcgccttcgtatggagcatcaaaataagatgcaaagaacataatcaatttattgactatactttcattctgcataatagatcctctgaaatagtcccggatcacaaaatacaaatttgaattgtccacaatattcaatttctcatcaggttcatttttatgaataatcgcatttcctgttgaatgaaacgtagcgatcggacactctatctgaagttcctcattaatcttttctttaagttcattaactgccttattcgtaaatgagactactaatatttgagatggatccacatgattcctctctacaagatattttacctttgccgcaaccgtcgttgttttaccagctcctgcaccagctattaccaggcaatagtcctcatctgttaaaatcaccctccgttgatcttcatctaatattatttgaggatctaccgatttaagaatattatctagatattctttttcttctaccatcgcctttttgataaagttatcgttatgctgatccatatattggtcaaaaaataatattttcttttctgcttgttccatatatgcttcctgtataccatttttttgacaaaacggaatcagcatatcactattttttaaaactgtaaaaaaatctattacttcctgatacttttcaatcctgttacgatattcgcttttggctatatacttatctgcttgtaaaaggctgtccatatattctattagttcgaataactgtaatacatatttatttttctcagctggtgtttcatctgtatttgaagtatttttctttctgaataggtcacgaataaagcccatgtggttactccttcttcaggtatatttactaatgggaattttgccacggtatttgtggactatcagatatattttctcattcgtttcctttattttaccattttttagggggatttcaactaaatgtcggagatataataattaagataatacataccttttaccctagagtatggtctttgttaaaacattcatcttttccaaaatgaaaggcagttccccgtggcgtcattttcctataatcccgatgcaactccctctgaatatttatcccacattgtctctgtgcaaacttatatatcttattttcttaatctaaacccacaaacctgcatagaatcaaggtttccacacaagagttgtggctgtttcaatgtacattgtacggttattaataatagtttgtgccgataatagtttattggcagaagtgttttaaaagtaataataatttttaaatcaacgctcacatttgtacatttccatgaacatccgaattgtttttcccttaccacatctttaataatggctttaacgacatcatctttacaaatttcaaaatttgtggctaaacagcttatatcataggtgcaggtgatactctttatcttaattttatgtcctaaactggattctaaaatatatgcatcctcaacaataaattctttctaaaatttatcccaacttcttgcgctgaaaggctatcatccaaatcataaaaaataattattttacctgtcgataaggtttcaatatgaatctcatcactctgtgctctaattattattttatctcctgatttgaacaaagcctaactttttagccattctttatcaaatttaatgtctaactctatgatatgcttaaaatatgcatttaattgataatgattatttatcattctttccttccaatcattatcattagactgacgtatttctaccaatttaattttgatttgtttagtatattcttttactccgctttgaaatccattttttgaaacaaatataccatttatgttgcaatatcctttaacgcagaattaaatcacgaatcttcccaatagatactcgttattgacaaatttgcattcgatggcaacttggtactcaaaaccagccatttcaaatctttaataaatatcaatttgacgatagcccccagagatacctttcaaattaatgttatgttgaatttcaagattattaacacctcttgcttggtgtaaacattcctattctttcccaaattcctttggtttttgtttataaccattctatccttatattagattatgatgttagtctataagtgtattgatgacaataatccacaattgtgagatccagtatctatgcattttataaatggataatactgagtactaacccatttacacctagattattttggattagtttattttaaagtatatttatgatactcattatctaaatgtatcacaaaaacaggaacccgttttattcagcctctatttcaacggtattacaattcgtaaatgttgagcacttaagtttcactgtataaccgttaccaagaattctatatctacaaataattacctcatttttttagaataattcatattcacaacacgttacgcatatattagtataagcaatcgctattagcacaactatgtgtatgacaaccataagagttggacgttatcttttatggttaaacgtcctgttggtgaaacgccaacatagcgattgctacttttttactatcttatttttagcatgtgctgttcttataactcttttctgcacatcattttctccaaaaaatatgtcaataatatgctgtgcttctccaaccaatggaatatcatggcataaaaaatatttacgcacaacaagcattatcatctgctttgttataccaagtgttgcatttttatataaagtttcagcttttattgccatctcatggaaatttcctgcattttcttccatcatgatattttggatcatataattcgtattgttacaataatcaaacttattcaaatcgtcaatcgttttaccattcacagaagtacttgcaacaaaatcatagacggaaagtatatatgcaacagactggttttgtaattcattagtaattatgtccctagtaattagtttaccttttctggttcttggcgcaccatctaaaatatcatttataattttgtcatagttttcatcaatatctttaagcataaaatacaataatttattagggtatctatacaatatatctaccacccattgtttttgatctccttttaagatatgcctaaagcttggcaatatctttgcgaccaattcaaggtatgaaatactttttgtaattttatttccaaatgaatttaccttactttcatcatatgaataaatactttccgcgttctgtttttgtttctcaataatttccttttctatagtggatttttcttcttttacccgttctttctcttttgaatctgccaaatcaggttttatatctgtgctgatctttgaaaggtatcctacattatcactatcgatactcaattcatcccattctttcatatgtgcaataaggctatccattatcggatttaaaatatggatattacttgttatatatgataaaaacagaataatatccccattaggttgaaaacaaatattatcaagaatatattttaactcctctgcaccttttctttcattaaatattctgttaagatgtaatgccgtaaaatatgccagtaaattttcatcacaaaattctataccaaacttttcagaattctcgcgaataatatttgctttaatagcagcattatagacaaactttggttttatgtcgttatcatattgactattatatgtttcaacaacactttcaaattcttctgtaggtaacggatactttttattaaaatgaatataatgagccacaaagtccaaagctatcatgatttcatctacattttcctctccagcatgctttgctagtcggaacgtaatatttgcttcgaacactttactaaatacattactttctttctgtgttttagtatacgaaaagcttaaataataatccacatactgatgaataaaatccggattcaactgaaaatatctaatctgatttgtaatatcttcatttatttttctcgttttttcagctatatctgtaatttttctttcctgaaaattagaacagatcctttctataagtctctcccgtttagcataataaaatggacagattttcatataaaacatcttactatcagataattcttccaatgttttttctttaatattaagattccaatctattccaccaaagataataaaatggccaaaattatcctcgaattcctcaacaaataatttccacttttctttacttatcttatcatatccatctacgataagaactttctttgcagtatcaagttgcatgaattcatcaaaatcggcattctcaccatactgatttgccaaagcatatttaattactttaagattatttttaggtgaaaaactttcttcttccaaaaaaataggaacataattgtctgatagcattctacataagtattttgccaaaattgtttttccggatctagtacttccctcaatagaaatctttttctttaaatcaaatagttccataaatttttcttctgtcgggacactataattcttcatatcatcattaatactttttgcttctaatgaaggaaaaacaaaataatctaagtatctctctcctgctctttcatcaatatctgactcaagccaatctttaaattcctttgtatgcgtaaatttgtattttcctctaaatgccacattatcattttttaaattttgtaccggtttatagatagaaccgttataaacaaatttatgcccaataagtttatgctgatctgtatttaataataaggcattaaaaccgtgttctgtctttgtgccatacaacgcaacaccacttgaaacatcgactgtatgttttgcattaacagttttgttttggcttaatgagaaatgctcatgccccacaaaaatcaaattagaggtttcatacaacttattataaagtgcttgctttgaaccatctgagaaccattctggaccatgatgtataatggaaagcgtataattttcttgacgtaccaaatctaatttgttaagttctctttgcggtatgtagtgaagccccttatcctcatttccatcgcataataaagaaaaaggagctgaattaattagattggcctttattgtgaactttccaaaagtaatctttctcacatcaatcacatttcctttggtataacatgaatttcttcgagcaaatgcataaaaatcatccaattgtgataattcagcataaaactcatcacctatttccttgtcagaagaatagtatccctttaattcttctatagttcttttaggatttaccactaaattatcatgatttccaggtgtaataagagtatatatttttttatttggcaaataagtttcctttatttgatttattaatgttccaaggaaattccctgctgtcttatactgattaatttctccggactgtgctatatcccctgaaaaaaccaatatacattcatcaaacttgtctatctgtttcaatccatttaccatagctggaatattaatatccctaaacttagtatcctctctaaaatgtgcatcactaagatgcaaaaataaaattttcatttgtatccctcctcaattcttatgacatcaaataagtgtccatctaaaaattgttttaccctctatttatgtacttctttgaactatattccatttcttttctctcaccgccattttctcctcttatagtattacttcgacgaacctttttcaatctgtaccgacttaaagacttccttagatattatcgctggattattatccgatgacaattaatgaacttcacttttacccgaattcaaaagtcgaacctctcccgtgtacttgtcattactcagcttaacatcaattgttcgtttatcccgctttccttttccagttagcgaaagatttttccgttttacatttctttgataatgcccctcaatttttgtcactaagatacagtctaaatatcaaattacaattttcttcatgcttagagccataactctttctgttataaagctttgctgttccggtcacacgatatttaatgtccattctaatatttcacctcttgattcatattctgcctattcaagagattaaataatagaaatcatcaagtcactatcggtaactcgaagtgtccaatcttcctactcaaatatcacacgaacatcgagagtttttaactgattcaatgcatccaaactttcaattgtatctctaccgaacctactactattttttgttattactatttccagttaacttgaaccacagtcatctagcatatgagtaaacttttttcttgatgatcctattttacttgtggaagtatccatatacacatcgcccagtatccactgggacattgctgatactaatctcattaggtgcgatacctgaacgatcattctttgtcattactcagtactatttgtacttacacagcaataaatatccactatattctcgttccggtaccaaaggtttaaaatgaatttttgaacctttctgcatcttattatcctccaatctctctcctaatcaacataaaccaataacttctgtatattgattagccaattcaactattctctcaactcaacatactcaataaccatcctgtctacacaacctacccaatatctatattgtacacccaactatccgtatggatatgtcccaagcattgatttatacacgactttatcaaatttcagcaccacttaaaatatgcaccgtttgtagaaatcccttaattcctacactttttcagttcattattacccaaccctcgacatcaataccacgcactccacatgtattgaagcgatgattcagattaccgaaaggcgtggtttttcttgttggaaagtttaaactccagccaaatcattaaatccaccacattttttgaggctcatcttcgactatgtattgctaaaagtatagcacaagaggtaatcatccgttaaaaatggcattacatacatcaccaaaaaatcgcacccttatctctttgctcgtcttcaattactatttttttacctgccgccttaaatccatcttttagctacttctctactaaaaagggcagaaaaaattgcgaagtagcctccagcataaatcaatatctaaatctttaatagttaaaaggaaaaaaagtgatgctaaagactgttgtattatcccttctagtatctattaatcaatttagcacacccgctttatggagctatgcttatattagacacaattatactaaccagattataatctctatttctctaatcacttgtcttccacataataagtaagaaacctgttgcttattttgttcctttctctattgcagatgccagtgcacgaagtctatttactactcctctttcacttttcaattcatatattgtattctctgcaaaaggtgcttttttcatcggagacaacatacctatttctttttgtgaaagagtttcaaaaacacttattagttcctccaaagatggcgaaatatccgtcgctcgcaacagcaaatacatatcacgggccgaaagtcctcccaacaactcctgttccttattgaatgcagaaacaacaagtgtgataacatccatctcccgctgtttagcagatattaactctgcaagacgagaaagtccttccggaacctcaaaaataagagagagttcctgtaaactcaatcccagttcagaagacatacgtgctatttcaattaattcggtatcgattatgagggcaaaccctttctttcgagcatgatttcgaatcgtatccccactaaatcctggtccaacgattgcaacaaaatctgcattatttttttctttgtgcgtctcaattgcaacatcacttatgtcactatgggatactgttcctccggattttgattttccatcgatgattcctattatgctctccccattatcatccttccaacggacaatcacatctgtgtctccggagccgccaactcttttcgcttcaaatcccataaaacggaaaatatcagcaatcctctcttcaagtgctactccagcacctttaccttctgccatggggtcgatcgctgccgcatgaagcctattaaaaagctgttctgtctcgtcagcatgaaaatcatccgaatcaatcatagccgcaacagcatctgtctcctgcttttctttataaatggattcatctatcaatggtaaatcgcgaacaaaacagtttccaagcggagttgcttttaaatggagataatgcggctcctccaaaaggccagcttccagcaaaaatccagcgatccacctggctttttccgtattgagcccatattccctggcctgtgcataaatatcattacgcacgatatcattttccgcagtcttaatcatttctccaacaaagcgcatatgtgcatgaaggattcgtataaaatccagatcatcacctgtctcacaccatgcttttgctgcagaagttgctatataggtattccgcccaacttcttctataagtcccgatgctttcaaaaacgggagcatggattccgcactacttgtcttaaggttaaactccttttcaacgaattgaaataattcaatttttgagattcgttccagcgtaaattgtgtaattacacgcaaattatcaatccggttgggacttggaacccaaatattgtaagtactacgttctctgtgtagttccggtgtttcaaataaacgctgaagtaaaacctttatttcaaaaggcggcaacgaaactgaaatttctttcattatggtttcgaaagactcaagcagagcgggtgttgcaagatgccatgtcttgagaatctcatctcctcgttctgtcgctctccattttcgatttccaacatcctctatcaattcaaggatttccagccaatccatcctctttcgtgtattactgcaatctccccaattcaatttatatctttcgcaaagccttgcgttaatttcctgcactgtaccaggttcaacggccagaatttcaagagtctctccaaaaagtcgaaacctgctttgcataatatttgctaaatgctgtggagtcaaatcatttttaaacgcaatgccactctcagtcaaatataatacaccagcattattgcctacaaggccaacacccttcaaaaacggagcatattctcgccacaaccttggagcggtaactcctttcagaacaggagatacatccatatctgttacctgctctgctcctactagtttcaccaattgtttgaccaacgaaaaatattcctgctttccacctaaaaggccaggaattgaccatgacttttttctccattcactcttttgtacttgaatctcatttttagccatatttttatccccttcctcgataggttcttatcttatgtcatagatttcctatatacaatttgttctttcgtttatcgatttaagttgattctccattaactcaaactattctcgacccaattcgacacaaacctcacaatgcaccgtccccggaaacatatcgcaccctctccacctcaccatctcatacccattctcccccaaatacttcaaatccctccccaaagtagccgaatcacagctcacataaacaatcctccccggccgcatccgcaccatggtttccaggcacttctcatcacaccccttcctgggcggatccaccacgatcacatccgcataaaccccatcttcttcatacttccgcggcagcacctcttccgccttccccacgaaaaactccgcgttcgttatcccattccttaccgcattctccttcgcgtccgcaatggcctccggcacaatctccactccatacacctttttagccttctgcgccagaaacaatgaaatcgtcccgattccgcaatacagatcccaaactgtctcttcccccgtcagccccgcatactccaaagcctgtccatacagcttccgcgtctgtaccggattcacctgataaaaagacagcggggaaatccggaacaccacgtccccgatcgaatcctcaattttctcttcccctttaagaacccggaccttcttgcccataatcacattcgtccgttccatattcacattcacggacacgctcgtcattcccggtatcttccacagttcatccgccagtctctgttcctccggcagcttcttcccatttataatcagacataccatcagctgtccgctggcaaaccctttccggatcagcacatgtctcagcagccctttcccggatacttcctcataagcggacaccccatatttcttcataaacctgaggataatctccaaaatctcctgattttcctccacccctaacgcacagtccgtattaggtatgatcgtatggcttcttcccgcataaaatcccgtcaccacattcccttctttatcatatccgaaaggaaactgggccttattcctgtaatgccagggatcctccatcccgataatcggttccatacaggcgtcaattttctccggatcaaacccgccgatccgcaccaggttattcctgattttattctgcttgaattccagctgcttttcatatgagagagactgcagctggcagccgccgcattggcggtggaaggcgcagggaggctgaacgcgaaaaggagaaggcacaagaaccttctccagctttgcataggcatagtttttcttcgctttcatgaccttcacctgtacggtatcaccgatgaccgcatctttgacaaacagagtaaagcctgcggcttttccgccggctttttcttctgtatccgcggcatccggggcagggagcgcaagcttgccaataccctcgccttctgtgccggtatcggttatttctactgtgagaatgtcattctttttgatatccatatatatttactccatccgtgtcatcctgatattggattcgaaaagccggttatagcccagccatccgtcatccttggcgttctgaagggcttccatgaaggtttccatcttggcgtccgtgttgtcggccaggttgagggcggcagcttctatgatggcgggctttttgggggatccgtattcgtattctccgtgatgggccaggatacagtgtttgagctcggcttccagtacaggcgggaatcctgggatggtgcgggccttctggccgatcatctctgtgcccataacgatgtgtcccaggagctggccgtcatcggtataatcgttttcggggaaaagagaaatctctttggttttgccgatatcgtggcagatggcagccgtgataagaagatctcttttcagtacgggataggcggtgcagtagtattcacagagtttggttacgctcagtgtatgttccagcaggcctcccacaaagccgtggtgtacggttttggcggcggaggacatgcggaaggctttgatgaaggactcgtcttccaggaaaaagctttccaggagcttcttcaggtactggttttccacactgccgataaaacccagaagctgtttatacatgtcatctatatttttggagcttacgggaaggtagtcggcaggatcgtattctccctcttcgcagaggcgtactcttttcacgctcacctgcagagcgccctgaaagctgttcacatcgccgtatacctcaatgtagtccagggtgtcaaattcagcaattcccgcgctgttgggatcccatattttggcatctatggtgccggttttatcctgaaggatcacattatcataagcttttccgtttttggtaacggcagactgtttatgtttacagaggtaaatgtcaaatactctgtcgccctcttttaaatctttaatatatttcatgttttctccaatccgcccgaaggctttttccttagtaaatggacggccttcagcggccccatatttatttcagagtatccagaatgacatccacggccatttcctgatattcatcttgtacctggcgcataattgtgatggtgatttgggagtcgggtaccaggctcatcatttccttattatattcctggaaggtggtgatttcctccgttcccatttttacaacgacgtctccgctctggatgcctgccaccatggcgggggaatccatcacaatgccggtcacataagctccggcgggaactccctgtgattcctggatttcttcggggacatcggtgccataaatgcccagggtggccatggcctggccgttggacagcttctcgatattgcttttcaaatcgcttattcccagggcggacaccaggtttttggcgtcgctgctgttgttgcgctggctgattattcccagcacctgaccgttcaggttgatgagcacgccgcttccgtttgtgcttccgtatatgtcagtggtgaggaggcggtaattgccgtcggtcaggttcagcacggtgtccatggaagtgatcatgccgtaggctacggagctgacgttgcccatggggcgtcccagggcaatgacgggcgtggccaggaggccgcttccgctgttggagctgccgagctttgcggctttgattatttccttggtttcttcggcgatatcggtcaggttgacgcagataacggccaggcccgtggtggggtcggactgtttcagggtcgctgtaacctgggtgctgtcgcagaaggtgacatgcactttttcggcctgttccactgtttctttttcggtaaggatcatgagttccttgccgttatcggctacgatcaggcctgcggtctggcccttgttttcataggtgttgttgaaccagtccacgtcggacaccacgcctgttacggtcaccatggatttggcggcgtcctgcaccagcttatacaggttgctgtaaagcttctggtaatcggaaacgctcatatctattttctggacgacggtggaggttacaggggtgctttccttttcctcctcgctttctgtctccagaaccatatcctcgggaagcatttcttcatttgccgcttcctcctgaagctgtacgggcgcaggatcctcctccgggtacagccagttgctgaaaacaggctcaagcaccagaaaggtaaagcacgcaataaggccgaaaatcaccgccatggaagctgtgataatggtgcgtttgagcagctttcttttattgacagggcgttccttgaccttttctttgataaaatcaatatctttgtttgccgtaccggagacagcctccggctggtgaagctcctctccctgttccggctgagagggcccgccggcttttttatctttacgatccagttcgttatctgacattcttttcctatcctctttttcctgtctgaaactttttctacaggtaagtttatgttccttttgctctgaaaagaaggaaaacttagccgcttacctttaacagtatatccgattgaggtttggttgtaaaggcttgcgggggccatggaaggggctgatatccggctttcgttactgttcactccgtgaacggtaaccggctttcttcttcggtttcagccggaaaaccagtacttatttgcgtccgaagtagtccgatgccagaatgccgtgcatgcagctgtcgcagattccctgattgttccagtccgcctggcgcagaacgccttccagcctcataccgcatttttccatgacttttccggagttggggttgttggaatcatgtctggattccaccctgttcacgcccacttcttccataaaaaaggtgatcagggcccggagcgcttcggaggtcactccctggtgccaccatctgcggccaatacagtagccgatgtgtaccattcctatctcttcgttctggtgtaccaccgcgatgcttccgatgggcatgtcaccgttttctttcagcactatggcccattggtaatatttttcatccggatattgacagatccagcttttcaggacttcccgggatacctccacgcttgggtgggtcggccacataaggaatttggtgacttccggatccgatgcccagttttcatacatgggctgtgcatcctctattctgaagggacgcagaacgagccgtccggtttcgattgtttttgtgcctgcatgcttcatatcgtatcctctgctttccgatgatcatgaaattgacaagaacagccggcggaatcgctcttccgctcggctgctcattcttccttctgccttcttttctcctcaattgccttccttgccttaccgacgctttccgcataggcggcgtccggtttttcatataaatatttaggtgaaaggaatgctgcgtcatagagcatttccaatacgtcctcctggacctgcgtcggttgtgtgggcgctaccactctggtctgccagacggacatacagccggtatattccaccatccagaaaagaggctccatgttcttttccatctgcccgttcaaagtggcagaatcttcccccgctatctcaatcagccttccgatgtgggacggaagcggttcatccacttccccgtcgggatggatgaggcattcacagtaatcctcatcttcccggtgggcattaataaattccattattttcataggtactgcctctctctgctgcggcttcctgcaaagcttatatcgtattccctatggtagcaaaaaggcggaggtttttcaacacaattttgcatgaaatgccctttttataacggatcctttttattgccgcaaaatctgaaaaaaacggacagcctaattccagccgtccgccttttcactgtcttgatttatctgcaaccttactggtttcccgcgcagccatgtttctcctcaccgcaggaatggttcccgcagttatggccttcttcatggtgatggctgcacatggtatccggattgaagtaaagcttccctgccagcagtgccgtcacattttggtcggcatccccggtaacgcccggataaaattcgattccgctctcactcagagccgctcttgcgccaccgccgatgcctccgcagatcagagtatccacacccctgtccttcaggaatccggccagggcgccatggccgctgcccgccgcactgaccacctgggagtctgtaatcattccgtcatttacatcgtagattttaaagttttcacaatggccgaaatgctggaacacttgtccattttcataggttactgctattttcatgatgatatgcctccgttgttgtattgcttactatagtctactctggtttctggcatatgtcaataactccgtcagagcagaaaatgtaaaattatcagatatttttgttaattatcagttttatttgtattttttacaaattgactcgcaatagcagaaacccttatccaaccgttttgccgtctcctctcctgtaccaatatattcgcctaatccggtatcattcctgaaaccggtattcttcatccaatccacagttatatcccaacacgctttttccattcctggtattgataattcagctccccggaaaaatcatcgttaactgtttcagccgccagtatactctttttatacaggttcccgaacatatttcccgcccgctctattataaatggcctggcccatttccaaagctcctccgccttttctttatattcgcagataagctccatgcaatcctcaagtatgtattcgaagagccggatgtgataaatttccgtaagatccccctcccgtattaattgctgaaagcagtcgtatgcctgttcctttttgtcaaactgaatatagtaatggagcaggcttctcaaagtgcttataatgtccgaatttttcccctttgcgcgggctatttcagccagggctttcaggggttcctcattttcctcttcccgtttgatatctttattgaaataaatcagccgttcataattacgcttatcccagcatgcaacgtcttccttccacagcttcaccaatttcctggccgattccatacagcccatgtcgatcgctatggaaatgccgtcataaatatcacagtcttccagttccgaagaaatttccacatttggggtgtaaccgcaggcgcagtcgaaattagctgttttggccctctcaaacaggctgtcgtaggtcccttcccgattatatttcatgagcagaaaggttaatatttccagcgcggaaccgattccctggaaactgtttgtctccctgtccttcagttcttcctcgaaaagccttttcacgatatcctcattattgatgtgtttatacaggagaaaatagctcagtcttaatcgattggtataatttttatcataggtgccgtgttccttatccttcgcctcaagataacagacctgggaaaaatcccctttatacgcatttttgtatagctgggcctgattttcaagaagctcttctaatatatccagatacatcaatacccctcccgccagtattttgttatctttttattataacagaaaaaagcatctgttttgccatcccgaccttaaacggcattattttgggtgtaaatggctgttgcatgtcctattctgacttttctatgtcggaatacaataatatatttattccggagctctcagccatataccaacttgttcttgactgttccctgtgttcttccttactttttctttcatctgaaaaaaagagcaatatttattcttccataaatatcactcttttcatagacacatgatttattttactgctgcagcaaacagcttcgctgcgccagacttcccggacatattaaaaatatatggataatacatcccatcctcctctatcgtaatttctacattataataagtatccccatcattactgatgccttcgcagacaatcggatcatcatacttcatatcatgaatcagtccaactcccatcggctgccctgcaaactcaccgtccatataaaagcttacctgcagaacactctcttttttcagctcccatcccttctccccatccttcatgaaaacaataatacttttatcataggaatcgacacttgagatttcatatatgtcatccgcagctttataggaacagtcatatattgtttccgcccccagttccttctgaagcttcagcaggcttttttcgtccagcaccttactggtaaattcatccggtatgatctggggtgagagcatcccctccgttatgatacgattcccttcctccgccgctgccggtacggaagcggccgtctgagccggctccgtatcctttcctgtacagcctgtacagaacacgctgccgattaatgctgtaattgttatacataaaataataccttgtcttttcaatctgtatcctctccttttatcccatgaaccattttgtatctatcaatagttatcttgtttgttcctatattcaattataaacaaatgaaatatgattgtggcggtatagtcctcaatggttaaaaaacgggcctcaatggcattctataaataaaaaaggtaaatatcattattgtctgatacttaccttcccttttttctattcaaataaataaagcaatactaaccgtaaagcattcttccgtaaaatgatattcaaaggttcctttatatttctcaacggcaagcctcacactctgcattccgatcccatgcagcagagcatcttttttactgcttaataatttattatcttcagcggcaatatcgcccccataagtattggaaatattcaaaataatagtgccgtttctctgaaccagatataactctattttccttttgttttctgtgatcttctggcatccctctatcgcattatccaaaaggttcgccagcatacagcaccagtcgatatcctctatattattttcatatacctccaattcccttatatttaccgtaatagcgcatctttccgctttcttcattttatcattcataataatgttgactatatgatttccggtatatttcttctgctgtaattctttaatgggatcctgtattttagagatataatttttagcagcctccagattgttttcttccagcatagaagacagaatcaatatgtgattctgcatatcgtgaaaaatcctgtccctgttctgatacaggtacagcatctcccgataactctttttcaccatattattgtgggtttgaaacaatttcacttcatttttcttttctatatataatacgaatacaatcatcgtcactaatataaacaggattaataaagggaaaaagacaaaataaatatcgattcgtttattcctgtaaacagttatatttaaaatctcatcacaatagaataagcctatatattccaaaaccaccagaataaatacaatcaacttatacttggtaagcaataaccggaacctgcccctgttgtaaatgatcagcaaaataataatcaatgtgattaatctgcttaataccatgattataattcgatcacgatttacatgaagctgtgccgtaataataaactctgttctgccgcttaatagctgtcccaggtaacccagtatgatatccagaaaataaattgtttcataatataatgccgttatgataaatccgtctgatgttttcagacgaaagaacaatttcagcaggattacggtcactcctatacaaaacagcatgaaataccgggaatacatggcaacctcaccgcgctggaatattgccgaagcacagaacccggcgattaagattcccagaagcaggctgctccaaagccttccgcttcttctttcgtacatcagaaaaaataaataaaaaagtccggatatctccgtaatcgtaagcaaagcctggataatttgaaatcctgtcatatcctgtccttccaaaaatgaagtatggtctttttcactttctttacaaaagttcttccaatatgcagtgtggtaccgtctctgagttccagatccttgtccacaagccttataatatgttctatatttaccacatatccccgttctatgtacataaagcagtccgaatccacttcatcgaatacctcccgcagaggcttcctgaacgaaatctgcctgtccatcaaaacaaaaaccgtattctttttgtctttatacatatatacgatatcttcatattccacacgttcaaatctggagccgccctctattacataagcctttctcgtcttcttacgcatttcggtcagaaatctttccaaagttccttctattttttcactgagcagatttttggggatatagccgaaggcctgtacctcatacccctctacggcatattccaaatgggacgtgagaaaaaccagcatggaggaaggagcttccttccgcatgaattttgccagttcaaagccgttcatctcaggcatttcaatgtccagaaagtaaagatcagactgccgcccctccttcaaatcataacgcagggtctcaggacaattatatagtctcagttcgtgaagtatattatttttatggaaaaaattccttatatatttactgaataaagcgtggaattcgatatcgtcatccaccaatgctattctgaccaattcatcgcctcctttttttgtattttaacagtaaaatgcatcatatttgttaattttgtccctaaatggcatctttttgggcgcaaaaggatgtttgcaggtatactccccgatagaattcccaccttttatatgctagaataaagtcaattaactcaatgtcgttgtccctcctcagaagaaaggaactctatgaaaggtttaagcatattttcctggttcagctaccccttaccactgcagaaacgtctggaattaataaagaatgcaggttttgatgccacctccctatggtggggcgatgaatttgaagataaaaaccaccagcctgaaatggcccgcaggctcggattagaaattgactatgtacatgcacctgccgaaaatccgaatgctctgtggctcgataatattaacggtgattcctatctaaatctgttgctttcctgtattgaagactgccgacgccatgatatccctaccgcagtcattcatgttacccgcttgtcttccagacctcccgttacccagcttggtatcgaccgtatcaaaagacttgtggagcttgccgaacaaaaacaggtcaacctggctcttgaaaatcttgacagcatcagccaccttgattatatctataaggaactgcaatctgatcgcctgggtttttgctatgacagcgggcacgaaaactataatcacccccaggccgactgcctgtcccgttacggggacaaattatttgccgtacatcttgatgataactggggtgatgatgatacccacctgcttccctatgacggcaatattgattgggatactttaaaagaaaagctgaaaaaatgcagagacatcccttatttaacattagaagtggattttaaccgtgatcatcacaaaagcctgatctacaaagatttatccccggccgcttttttatcctccgcttatcagcgcttactgcagctgcaataagcagacaaaaaaaagcacaggaaatcgggatgctccccttcagctattgtatgcttcatatacagaaaggaggtgcccaacatggaatggacagaatgtatcagtaaagcgattagctatatcgaggacaatatcacggaagagctcaccatcgaagacattgcggaccaggctatgatttcaccgttctattttcaaaaagggttcgccatgctttgcggatttaccgtcggggaatatatcaaaaaacgcagacttacgcttgccggcagcgagcttgtatccaccgactggaaaattattgatattgcacttcggtacggctatgattctcccgacagctttaccaaggcatttacccgtttccacggggccactcccacttctgtaagaaagggcgaaacgatcataaaagctttcgctcccctgaaaatcaagcttacattagaaggaggctataccatggattacaaaattgtgaaaaaagaagcttttaccgttattggtgtatcaaaggtattcaagtacgaagatgccgccagcgcggttcccggattatggacagaattttatcagacaggaaagaaccagctgatcagcagccagtacggtatttccattgatgaaaaaatgggaagtaatgagttcgaatttatgattgcggataattatgaccccgtccgggaaattcccgatggacttaccacaagagttatcccggggcatacatgggccgttttcccctgcaccggcgactcttcccaaaccataccggatgtacatgggaaaatattcagagaatggctgccgggctgtcaggactatgagatagcggcaggatatcatatcgaaatgtacaatgaccctgccgattatacgaacgggactcaggatgaaaactattattgtgaaatctgggttcctgtcagacagaaataaacagaatttctttccaggatctaacaggggcaagcagaacactgcctgcccctgatttatgagcatccccgatatcatctgcttatctccagctccagacacttccagtcttcctgaaggatatggtagttctctctttctcctgtatccttgaatccaacggatctataacagcaatacgctggccgattattttcgaatacgccaagcgttactttttgtgccatcaacagctcaaacgcatactgcagcgacagggtcagcagctctttcccatagcccatccctctttttgcattatctacgataacaaatccaaagcgcagctcttttttatcagaatccgtaaaacgcataaacaggtgcccggaaggcttatcatcatcaaaagccgtcatcgggataaaatcatataataaagcgtagttatcatatagcttattcacatcttccgcagtaatcggatagctgtcaaatctgtcggcactccattttctgaaagtcacttcatctttaatccatgtaacaatatattcggcatcactttttctataaggccttaaacgcagcatagatacctccacaaatttccggataaatgaagtataacattaatgagaaaagaagaacagccttcttattttcacagggaaatcatgttacaatacaggtatagatcccctgccgccggaaacaacagccgccgtttgcttattgcatttaaggaatataccgcctatgaaaattgacagattatacgcaataaccgtatacttgctgaatcacggaaagacctctgcttccgggcttgccgggaaattcgaggtatccgtccgcaccatccagcgggacatcgacgccctctgccgggccggtattccaattgtggcggaaaccggagcttccggcggatattatctttccgaaacctatcatatggacaggcacacagcgacccaggaggactattcttttatcctcactgccctgaagggtttttcctctgccatgggcaatccccagattgacgcgactttggaaaaggtttcttcccttacaagaaatcaggatgacagcatcattcttgatttttccgttctgcgcgagggagatgaaatacttctgaaaacgctgcggactgctatacgggataaacatccagtcagcttcacctataccaattcggagaatgtaacccgcatacatacggtggaaccgatagccgtcatttaccgctggtatgcctggtatctgctcgcttattcgaccgtgaaaaaggattacagaacctataagcttatccgtatgagcgatgcggtaatatcagacatgccttttactgcacagcatgcttccccggaggaaattctgcgtgaaagcgacaggaaatcacctcagccttctacggaagtaattgtccggtgtaaatccgaggcaaaatcaagggcaatcgaatatctgaacggaaaaatccttcgtacgtatgaaaacggtgactgcgaaatgcttctggaagtcatggaaaaagaacatttttggttcggtactcttctgtcgctgggcagcggggtagaaatcctggcgccggaacatatccgggtgcgcgtgttggatgctgcgaaagaaattgtttccttatatgaaggaaaataaatagcctttcccaaaaccttgtttctcgataattataaaggtattttttcgtttgaggtgatacagaccctgaagctgatcgacaccatccatgacatgattttattttacttcaatggctcggcactgacggtcttccttgcggtgggctatatgcgaaccatacccagagaactgacggagcggccattgtggacggctgcagcgtaggcggggtatttttccgcatcgtattccccctgatgaagcccatcaccgccacatccatcatttttaacaccatgtggatgtgaaatgacttcattatccccaacattttcctgatatgcataaaaaacccaggtttattcagtataagtatcgctcagaagtctctgcgtaaaaaacacactgcccttataaatatccccgtctattcctgcttttctgacacaaatagccgtaatttcatggggattgctatctttgcttattcgttccaaatacttatccaaagatatcattatttcttttccgtgctcaagactcacaagatcatagggatagctctgtgtattcagaaggtttatttgctcaaaattatccataaaaataatggcactgctctccgtctctccatcgagatttcctgcttctatgaagtattcatttccgttaaacttgttaattactataccatttgttctcgcttctatcatatcaaattgctgatatgtaaacttattagcgaaagcttccttaccaccaacaacagccagacaccttaacgcagtaccccctgtctgtaatcgctcctcatctgtcaattccatatatgtatccatgaaaacagcaaatacaagatcgtgtttcccttcttctaatgaagatattgtaatgggaatatttatatctgatttatttttaatattcacagtacattgcctcattaattttccatcaacctcaaaatcaatctgcttataattatcaaaaataactaaagtaaaattaaactgttttcccatattattcgtgaaagacataaaagtacgcagcttattattttccaaataaacagtagtatcatgcatgtactcagagttttctccccataagccataactataatacgttttgccctcaaatccgtccatcacttttacttcgccattatacgtttcactaaatttcgtatatatttccggaacattcgtttctttattgctgtttatactctggtttccacagcccgataaagtcagaaataaaaacaagaatagaaatggaatactttttgtaacattattgtactttcttacttcattcattatataattcccttactttccctttctttatatacatctcttaataaaaaaataaacaggcctgaaataactattccaggcctgccaagattctaatataggatttcaccatatgcttaaaaattaattattctaatatgtaaacataaaggtttcaaaatccaaggttacttattagactctcataaaacatagcaccaaaattaccgcagcatcatatactttttttattactatatcaagagaaaaccacacagccagcttgtgaggaaccctttaccttttacaaatcagatttattatttgatttcgactaacaatgatctcacaaaatctgattttcccgtcacattaaacaggtatggataatattccccatcttcacctatttccaattgaatactgaaataagctttatcatccacattttcgccccgacaagtaaatggcgcttcatatttgttgttatgaataagcccaatatccattgattgtcctgcaaattcattagccatgtaaaaactaatttttataaagtctccttttttgagattccatcctttatcttctgtctgaagaaaaacaaggaagctcttgtcataagaatccagtttaggaatttcatattctttcccttcagttgaataggtacaatcatatattgtttctgcctggagttcttcctgaagccttaataagctctcctcatccaaaaccttgctgacaaacttttctggtatgatttgcggtgaaagggtatcctctgttataatacgatttccttcttcttcccctgctgaactgacagaaactgtttgttccggtacaaaacttgtatttgaacaacccaaaacaaacccacttactaaaacaaaaattataattaaaacacttttcctcaatatatactcctttaattaccattaaacatagcttgcgttattgttattgtatacgaagatttattccagacccgataacgtcctctgccagatgccggtgaattatacactgatgatatataagttgttgcacctgtcgaattataggtatattgtggaattccaactgagtttgttacctgtaattgtaaattagcagccggagttactcctacagacattgtattatttcccgtaacgacattaacatcccattctgcaccagctcccacaggaatcgtaggatttgagatccccaatctgccagtaatcattacatttccattctgatcaattattctaaagggttgtccatatagattgttctcatccatagtattttctgttgcctgtacagataaagtcatacccaaagtcatgactacaaccataataaagctaattatttttttcataaaatacccctttcattaataagcaaaatcgatttgtattcttaattaacaaaacaattacttatgcactggaatcacctccattattatttgcttgttatatttaaatacaagtgtcaattctatactgtcacaaattatctaattcaaaccttattcctgtgcgggaattaacaaatatatctctgtactctatatgcacttattataacaagcctaaatcagttttgttaaatatggcctgaacagtcagaaaaatgagtatgaatggatcaaaagtatatctccacacattaaacacaagtatcagaatcatacaaaaaggcggacagctttgtttccgctgcccgcccttcgttccgattttgtcaacaacaaaaaatggataaataaggagtattgatagtaaccgccctttcatccttatccatatccagacttacttccatagactcccgttcaatttccaaatcccctgcagtaatcatataattatttctgtcattattcatcacaccaccacctttttataaaaacaaaacaatattaaccctaaatatatgatccataaaactatactccagagtcccattattcttctccactgcatattttacactttccattcctatcccatgcaacatcttatcctccttcaaggtatacagcttaccatccataagtttcacattcccgcaataaggattagatatgtccagaataatcatctcatccttgcggaccaggctgaaatcaatcctccgctcttctacagttaccttttcgcacgcttctatcgcattatccagtaaatttgccaatatagcgcaccagtctatatcctctacagcagtcataaagttcccaactacttttatattcaaagaaacatcaaacaattttgcctttttagccttgtcattcatgatgctgttaataatacggtttcttgtatacctcctctgatccagagcttttataggttcttgtattttcttaacatactgccttgccttattaaattcttcctcctccatcaatgaggaaagtatcaccaaatgattttttatatcatgggaaataatatctctctgttgataaagcattaccatatcctgataattcttttccatcatgtcattccttatatgaatagcggttatctcatcctttttttcaaaatatattataaaacttactgtccacgccattacaagcaaaagcaataatggaaaaaagacaaaataaatatctattttcctattacccataaaaagaaatacctgatcacaatagagcagtactatatattccagcaaaacaaaaaatgcaaatatctttttatattttataaatactctgcggaccaccgccctgcaatttaccgaccaaaacaccattcccataagaatggctctgctgaaagccataataaccacccgttcagcactcatttgtaactgaatattttcagcgaattgtatttctttcactgccactgtccatatatatacaaataatacatcaaataaagaaattgtttcaaaatataatgccgttaatataaaacatttccaaaaagccatcttaaaacacagccaggctataacagaggaaatacagatacaagtcagcataaaataacgggaatacaaaccgctcgtaattctctgataaataagcagaagacttactgccgtcataagaaagagcagcagaccagatttccatttcccggctcccctcttctctgaaaacataaaaagtatataaaaaattcccagtatttccactatggaaagtattccttcccaaattctcagcacgatcatattctgtccttccaaaaatgaaggattgcattcttaactttaatttcataagtcctgccaatagggagcgtttccccatttcttaccacgatctctttgtttacaagcctgacaatatgttctatgttcaccacatatcctctttccacaaacagaaacccatctgtccccaagtcatcaaaaacagctttcagggatttcctgatacggacttccctgtccttcagcacaaaaaccgtattgtttttctccctgtataaatagataatatcatcatattccagttgttcaaaccttgtatccgttactattcggtatgttttattatatgtactgtgatattccgtccaaaacctttggagagttctatccatgttatcttcaagcaggctctttgggatataggataactctttataattgtaaccttctgctgccagttcttcatgggaggtaagaaaaaccagatacgcctccggcgcttccttccttatttttcccgccagctcaaatccatccatttccggcatttcaatatccagaaaataaagatcccaatgctttccgttctttaaatcatatactgcttcagccggactattatatagccacaactcatgaagcttttccttttcccgaaaaaaattctccacatgccggcaaaataccgggtgaaaatccatatcatcatcgatcaacgctatatttatcaatctatcagccccttttaataatgataacaaatttttattccttttgcctggtttgtccttaaatggcatttttttgggtgtaaatgattaaaggaaagccataatcttatttttttgtatgatggaaagcagtacaattaatatgttataataactgtgaacccctgaacgggaagccccgggcatccctccctataaacaggaaaggattttttatgcactccaaactcatattagtggaaggaattcccggttcgggaaaatccaccttcgcacagaaaatcgccgactgctatagcacccgcggtcaaaaaacaaatttatacacggaaggtgattatcatcccgccgaccttgcctggaatgcccgtcttcccctggaagaactggacaatatcctcgccccttactccgcattccgtgccgacattgataaaaatacccatatagaagacggatatgccatcatatcctatacccacgtcactaccgacacccctgaattttataaagccatggaagacagagaggtatatgacagcaggatcccctttcccgaattccgtgagttaatccacaaaagatggctcgccttcggcacacaggcaaaagaaaaggatgaactcaccatattcgaatgcgctttccttcagaaccaggtcacagagcttatgctcatgcagcttgccgatacagaaacaatgatacaatatttcaatgatctcatcagcacggttctgccgctttcccctgttctgttttacctttcccagaccaatgtaagggaaaccattacgcgcgtcgccaaacaaagagtctccgaatacggctcctggatagatgccctcatccaatacatggagaataccccttacggcagaaaacacggcatcaatggcttcgatgatgtgatccggaccctggaaatacgacagcaaaccgaattggaaatcatccgtgcccttcccatccgcacccacatccttgaaaattccagctatgactgggacgcgctgtggaaaaaagcagaatcctacttaccctgacaatcttagcgtcacatttcataccggtcccgcactttttctgctattggatatcttctctttgcatgttataatgtcgatagcctgataaatgccgtatccatcagttgtaaaccttttaccggagccaaaagaccatgttttatttacccggcagcctttcaccgccgctgcccctgtttatcgcaaaaaggagtatcaaacccgaaaaatgaatgcaaaagtattaaacactcttgaatataacaaaatcataaaccgcctcaccgaacatgccacctccgatcccgggcgcaaactgtgccgggaactggtgcccatgacagatttggaggaaatacagaccgcccagatggagaccagggatgctctcacccgcctgtttaaaaaaggaagcatatccttcggcagcaaccgtgagctgggcatgagcctgaaatccctggaaatcggcagcaccctttccgcgccggagcttcttagaatcgccggccttctggaaaacgccgcccgtgttaaaaattacggaagacaggatcgggaagacacgcccgaggactcccttaccgcccttttccagggcatcgagcctcttacgctcctttccaatgagatttaccgctgtatcctttccgaggaagaaatcgcggacgacgcaagccccgggctgaagcatgtccgccgcagcatgtccataaccaccgaccgcatccattcccagctttccggcatggtgaacggctccctgcattcctatctgcaggacgctctcatcacttcccggaacggccgttactgtattccggttaaagcagagtaccgcagccaggtacccggcatgatccacgatcagtcctccacaggaagcactctgttcgtcgagcctgccgctgtcgtaaatctgaataaccagatgcgggaactggaaattaaggaacaggaagaaatcgaaaaagtacttgcctccctcagcgcacaggtagctgagcataccgaggatatcgctgaaaaccagagaatcctcactcttcttgactttattttcgccaaggcgtccctcgccctggagcagaacgcaacggaaccgattttcaacgaggatcacatcctgaatatccgcggggcaagacacccgcttctggataagaaaaaaaccgttcccatcgacatccggctgggaagggattatgacctgctgataatcaccggccctaataccggcggtaaaacagtatccttaaaaaccaccggccttttctgccttatgggtcaggcaggccttcatattcccgccctggatcgttcggagctgtccatcttccgtgaagtttatgcagatatcggtgatgaacagagcattgagcagagcctgagtaccttctcttctcacatgacctccatcgtttccatcctcaaaaatgcggacgccgattccctctgtcttttcgacgagctcggcgcgggcacggatcccacagaaggcgcagccctggctatcgccatcctcaacttcctgcacgacagaggaatccgtaccatggccaccacccattacagcgagctgaaggtatatgccctctccacctcctttgtggaaaatgcctgctgtgaatttgatgtggaatcccttcgccccacctaccgcctgctcatcggcattcccgggaagagcaacgcctttgccatttcatccaggctgggcctttccgatgatattatcaattccgcccgcacccagatcagtgcggaggctaaaagctttgaagatttgcttaccgatttggagcagagccgtgttacaatagagaaagaacagctggagatcgcttcttacaaaagagaagtggaagccctcaaaaagcagctggaagccaaacaggagaaaattgaccaggcaaaagaacgcattctgcgggaggccaacgaacaggcccgtgaaatccttcaggatgccaaaaatacagccgatgagactatccgtgcctttcagaaggcaggccccggcgcatccatgaaggatctggaaaaagccagggaaaaccttcgcggtaaaatttccgataaaaacgaaaagctggccgttaagaaccagcagcccgcacagtccggtgtcaagccctcccagctgaagctgggtgaatccgtccgtattgtttccatgggactgaaaggcaccgtaagcaccatgcccgacaacaagggcaacctgttcgtacaatgcggcatcatccgtactcagaccaacatccgggacctggtgcttatccaggaaaaagatgcgtccgccaccgccaaagccggccgtaccggctccggaaagatacgtatgtccaaatctctttccatttcttcagaaatcaacctgctggggaaaacggtggatgaagccatgtcggtgctggacaaatacctggatgacgcctatctggcccatctttccaccgtgcgcattgtgcacgggaaaggaaccggcgcccttcgtaatgcagtacagaaccatctgcgcaaagtaaagtatgtaaaatcctaccgccttggggaatacggcgaaggggacgcaggtgtcaccatagtggaattcaaatcctgagcctgatatagcgggagccccgctgcgcagtatttcaggcatgctctttcctcattgtaaaggagacaacttacatggtaaataaacagaaaattttgattgtggacgatgataacaacatcgcagaactgatttccctgtatctgacaaaggaatgctttgaaaccatgatcgtaggggacggggaatccgctctctccgcggtggacagcttttctcccaacctgatcctgctggatctgatgcttcccggcatagacggctatcaggtatgccgcgaggtccgcagcaagtccaacattcctatcatcatgctttccgccaagggagaaatctttgacaaggtactgggccttgagctgggcgccgatgactatatggaaaagccctttgattccaaggaactggtggcccgcgtgaaagcggtgctgcggcgctataaaacagcccccgccgctccggagccttccaatatcaaatgcgtggaatatccggatctcactgtcaaccagacaaactactccgttctctatatggggaaatcagtggaaatgccgccaaaggaactggaactgctttatttccttgcttcctcccccaaccatgtcttcaccagagaacagcttctggatcagatttggggatatgagtatattggcgatacacgtaccgttgacgtgcatatcaagcgtctgcgggaaaaaataaaggatcatgaatcctggaggattgctacgatctggggcattggttataaatttgaagtaaggcaataaactgaggtgaaacaatgaggaaaaccctctatttaaaattcctgctggcctacctgatatttggatttttcggcttcatcgtagttgccacctttggttccagcatgactctggaacatatgaaaagagaaaaagcagataccctatataaggaagcgactctcatcgccaatacctatgcatcagatctgtataataacgaagcttccctggaaacggtaaaaattcagctggattccctggctgtttatctggattccaccatatggatcatcaacccttccggccgtatgataatggacaccaacacccctgtggatttggatcatccccgtatcgtggagggctttaacgctacggaaacagtcggctcctattatacaatcggtaattttttcgacagctttgataaggaaatgttaagcgtctacgcccccattacttctgatttcaaggtacggggatatgttgtcatacacacggctatggcgtccctgcgctccaccagtgaaagcctgctcagtatttcctatattattctggtaatccttttcctgctgtctcttatcatcctcatcttttttacggagatggtttatcttcccctgcgtaaaattaccgaggccacggagcagtatgcggcgggcaacctgcattatgaattccaggtggacagcgaagatgagatcggttatctcgctgcgtccctgtcctatatggccagtgaaattgcccgcggtgaggacaaccagaagaaatttattgccaatgtttcccatgacttccgttcacccctgacctctatcaagggttatctggaagccatgctggacggcaccatcccccctgagctgcatgaaaaatatctgaaaatcgtcctgaacgaaacggagcgtctcaccaagctcaccaacagcctgcttaccctgaataacctgaataccaggggtatggtactggaaaagacggattttgacatcaactccatcatccgcaataccgccgcctcttttgaaggaacctgccagcaaaagcacattgccattgaacttgtgctcaccggtgaacagctttttgtaaacggtgatatgggaaaaatccaacaggtgctgtataacctgctggacaacgcaattaaattttcccactccgattcggttattaagatagaaaccacggaaaaaaggaataaggtttttgtctccattaaagacagcggaatcggtatccccaaggaaagcctgaagctgatttgggatcgcttttataaaacggacctctcacgaggcaaggataaaaagggcactggcctgggcctgtccattaccagagaaatcattcaggcccacaatgaaaatatcaatgttatcagcaccgaaggcgtgggcactgaatttatcttcagcctgcctgtgacagatgatgaagacgaataaataaatgccgggcggaattgtattttttcccgccccacgctttttaaggccggactgccgggaacaagcttttgtttccggcagtccttttttatttccagatattgtttttaaaaaatataaacggggtattgacaacattatcatagtgttctatagtgtacttatacaacaagtacactatagaacactccggagggttttgtggaaattataatcagtaataattcaagcaagcctatatacgaacagataacctcgcagatgaagtcaatgattatgaacgggcagctgcaggcaggagatgctatcccttccatgcgcgccctggcgaaatcactgcatatcagcgttatcactgtccaaaaggcttatgaggatctgcagagagacggatttatcgaaacaactgtcggacgcggcagcttcgtatccgcaagaaacagagatttttatcaggaagagcagcagcgaaaggtagaggaatttttgcaggaggctgtggaaacggcccgtgcctgcggtattccgctggaaaagctccaggaaatactggcactgttctatgaagaatcagaagaataatatggcgtgccctgcgcgcagatgggagaaaatatggtatccgcattacagataactgacttgacaaaagaatatcccggcttcaagctggatcatgtttcctttactcttccccagggaaccatcatggggttaattggagaaaatggcgcaggcaagagcaccactatcaacgccatattggatttaattaagcgggatgaaggatccgttaccttctggggagaagagctttccaaaaatcccagacagctgaaggaaaatatcggcgttgttttcgacggaattaatttttatgaaacgcttactcccgtcaaagtgggaaagatttccgcagctgcctaccgtcaatggaatccggttgtttacaaagactatctggataaattccagctgccctccaaccaggaaatcaaaaccttttccaaaggtatgaaaatgaagctgtgtatcgccaacgctctttcccatgattccaagcttctcattctggatgaggccaccagcgggctggatccggttatgagagatgatatcctggatatatttctggattatatccaggatgaaaatcattccattctgatgtcctctcatatcacaacggatttggaaaagattgcagactacgtcacatttatccatgaaggcaaaattgttttttccaaaaccaaggatgagctgatttataattatggcattctgcgctgcagcaaggatgattttgacagaattgatccgggagacatcctggcttaccgcaaagaggattatcagtggaatgttcttgtggcagacagggataaagcaatggcccgttatcggaatgttattgtggatcatcccaccatcgatgatatacttctgctgtatgtaaagggggaggctgcgaaatgaaaagcttaatacttaaagacatctataacatactccataatatgcgatccatggctgtacttctgctgttttttatcatatttatgataccccagggcggaacggcggcgtatcaggttacctgctgcctgctgtgcagtatgatgataatgactactttttcttttgacaatatctccaagtgggaaaaatacgcattggttatgcccatcaccaaaaaggatctggtaactgcaaaatttcttaccttaattatattttctgtctttggtgcggtaaccggttttgtactgggtattgcaggaggagttgtgttcaagagtttccatattaattccccggaggaatggattacactcctggcagtggccggtataggcatggtcatcggaattttcttcggaagcctggtaattcctctgctctttaaattcggtgcggaaaaagcaagaatgctttctattgccgcttttgcagcccctgccgctattggcatggccctgtataaactgctcgacatgttcggtattcctctttccgagaagtttattaccaatctgctgtatctctctcccctgcttgttatcgtatgggtatatgtcatgtatcttatcagctgccatatcttccaaaagcaggatatctgaatccggcagcggacgatacgcactccggcaccccatttgctgaatatggcttatatatagaacaggagggagttaaccactccctcctgctctgttgtaatgatgttatattatggcgcatctactaattcccaatgaatggtagtggtataatttacgccgctgtatatttccccgggaaagaggttaagcagaatgccctccccgtcgctccactgcaccgtgtgttctcccggcgtgccgccggtttggtgataaattgtcataggcgcttcatttaaaggaaatggcgcactgcctgcctttcggaacaccacggcattatcgatccgcctgggaagtccgtccacctgtgccgtcaatggctgtgtcaggctggcgtctatgcgccaaccggttggtttggggcgggtgtcgcctacagtaagggcgaattcatccccttgcgggttcgccagggtttgtatttcgggaaccggtatactgccgaattgcagctgctccggcacagacacaaaggaaagcctgaattgtcccgaatcctgcacaacagctgtttttcgcatggctatgccattggcgcttgctgtaatggttaccacgctgtccgccttcagcgttccgcctgtcacgggaagcaaatactgtccgtaggcgccggcaattccgtctgttgtcccatccgtgccgtcattcagggtataggcggctgtcaatgccgcaccgtaggaagtatggccggaaatggcaaggctttggctgtcaggcgtatcgatatccagcgtcatggaacccaaggcgacaagctgatttttttccaggttaaagttttgcgtatccagggcggaaaccaccggatcatcgccggtcaggttggaagtaaggctcttgattgtagtgtcgtaggcggctgtcataaccagcgtttcgccgtcggatttattccatatatggtcgggcaaatcatctgtgccgccggaaacaggccagcctgtggactgccaaaggttcagagccgatgtgcggatggaaagcgtgcccgcaccggtaaagcgcagcggcaccccggctgagctgtaaagaaaaacccgctcgggctggttccatatcacctgggcattggaattggtcatccgcaggggaatgccatccgtaccggtacgcacaatggtggctgaactgcccggttccatttggaacaggctggatatgcgcagagccgccaggctttccctggtgtcctgatagatgttgagagccgcatcggattccacaaggaagcgtcggacccggtaatcgccgacagtaaagccatagcggctgctggtaagatggaaggcggatccggagcacagcgtgacgtcgggggtctggccgtttgtgcccaaaaatccgtaatcggtgttgacagtcacctctgtgccgtccagaacagtcagcgtggagacactgcttgtcagctgaaggacgggatggtttgtgccagcggcgctgatatgaatcgtaccggaaaattccgcgtgcatggtttcggcaatttcgccgctcatgccgctgacaggacgaagggtataagtgctgtcggccaggcgggtagtgccgctgcggttgtaaaccggctggggaccggtatagtccacattttcatggattatggcgataccggaaatggaatccggcacccagacgacaccataataattggcaccatgaatatccagatttcgcagagtgactgattggattcccgcactgcgtacccggatcgaggtgctgtcattggcagaggtatattgggtaaagcggtaacgcccgccctccggcgggacgccgtcaatgatcacatcagtcttattgggatgaatatcaataccggttccgtctgcggtaatgttgtctcccaggtagatagtggtgtaaccgttgtcgccggacaaagcttgtttcagttcgtcataggtataaacttcaatggtggtttcgttgaggatccgtccaaaagccagggcttccccgccggattccgtctctgattcgacagtttcctgatttgcttcggtgagttcttcctctgattcagcggactctccatcagtttccgtcggcagtaaattgtcgtctgccggcgcttcggtggaattttccgcagggaattcgctctcggaggattccggcggcgggagcatctcctcttcaggaggggcttcacccggcacttcgcctgaaggcggtgagtcactgttcccaggttcctcctcagccgggttgctgttctcaggcagcgtattcccctccgggagctgtacgatattgaaatctcccggaaggttcgtggcagaagcaggcagccccgcacgaaaaacgagggccagcactgtcaggatcatcagcagtttttgcaaggttttattgcgcatggggctcctttcggtctgtttgttatggggccatgggataagtttgccggtctttttcgcggcgtaccagcagcaggatgatcataagcaggatcaggacgaggatacccgtgccgatcaaaagagccatcatccaggaaccttccgaggaaggatgtgcggccgcgccgggcaaagccgtgttgagttcatcggcctgtacactgcctacagtgaatggctggagaaaagaccagctctccccttcatagtccagtgtaatctcactctcataattgccgggcttaagctggggaatgtctcccccggcgttttccgttccgtgtgtaaatggggcaatattctccgaggcgctatccgttccggaattacccgatattggcgttacacccagaggcatcaccgagtttggagccatatccacgccccgacgggtaaattcgccagctatcctgccgctctcgtcccgtacaactatgtgcaaatccacacctttcgcaatggcagcctctttgttgcggatgaagtggatcatggcaggacggtagttgacggttccggcctccacacttaccagttcaaaacctggctgtacatctacatccgtttcactcagttttacacccagcacatagctgtatatgttttgcagggtcaccccttcggcgggggcattgtcttcaggccgctgggtaaacaccagaccgcccaaaaccacgccgtcgtatacttcggcgggcatgtcgatagtgatgcgtgccatggcagtgctatgcgcctcaatgactatgctggtatcctcgggcgctgcaatctcggagaaaggtattttcagtgtctcatcccggatgtccggcgttttgtagtcaatgataccgttgcggttggtggatgcgctgacagcggccagatccactgtgataaccttgtcactttcatttacgacctccacctccagtgtctgggactgtcctggctgcatacgcaggtcaaagtaactcaggttattactaatctggttgtccggcagcacggcgcgcacataatagccaataccatctgtctggccggcagccgcctgcgcccgaagagctgggacaattcccagcggcatcaggacgatcataaccatgatgaacagaagtcgggccagtatttttttctgcagcttctttaaaaacataatctctccttttgttcaggcaccatcagggcgtactctgcagattccaggtaaggacagcctcgctgtcgccttcctctgcagttccgggatacacagtcagtgtggtatttccggcgatccattccaactcccatacacccatgccggatttttcttcggcattccaaacacgggtaaccgttccgtcggaagtcaattcaatttcggtaacctgcaccggcggcttaccgaggttttcggcgttggttttaacggttggggcggacgtattaatcacggctccggcaagggtttcgcccccgtcttccttcagctggaatttggacagagccaccgtcaggctccagccctcgccgctgccgcgtaaatcgctgatacgcacggaatctccaacgctttcggcagtgtagacctgtacggcagcggaaatttcatgttgcccaaagtccagggcaggcgcggcctgcagcttcaggtcgccggctttaaagctcacgacggcctgggtatctcctgtggtactatctccgactgcggcggcttgcaccggctgatttgtcatggtcagaatcatcaccgccaaaagcgcaaaaagcggaatcttttttccaatttgttttgtcttatccattctaagttttctcctttgtattcaatttcgcaaatctatacaagcaaagtttagatttaccttgagaccaagtataccaaatgcgaaatcgcgtacaacacccttttgaatataaaaaaaagcggcgctgctacaccgctgtttcttactctcgtttgggtattccctgccgccttcccgtaacataacagaaggtcagataatttgatttgccatggcgatgcgcacggcatccgcgctgttaatggctcccagtttagcaaatacctgcttggtcatgcttttcacggtattcagactgatttccatactggcgctgatttcttcccgcgtaagaccctggctcagattctccagcaggtggatttcccgtttgctgaggccgaaatcctgtcggagattctgctgctggtgatagcggcctgtaagaaaggcatggcgtttagcgaaggtagaggctcgtgcatgtacctcttccagccagccggaaggaatacccggtattccagtttcacgggcgcgctgcagcagcgagcgcgtgcggttgccatattcgataaaaggcattacaatcccatttccgccggccagtttgtaggcggcctttaacgctgtgtcagcagaagtgtgctgtctgaggtaatggtacgtcaccgcgcgggataactgcacatatatttgggtaatcacagcgcttttgcttttggccactgcttcaaactggttcagcaaagccagcgcttcgtggtaatgcccatcagcgatcaggcagcgaaggcgtaccaggagcgcccgctcaatgcctaccggggcatgcccatactgcacggcattgcgcacccagccggctacgcggtttgtttcacccagctcggaataaaaccagccgaaggtgatgtcccagataccaaaacctgcggcagcatccattttttggtattcgtgcacatgcttcagcgtgtcctggatattttggtactcccccagcaccgtgtaaatacgcagcagcataaacagcgcgttgccagcaatgtcatactgggacttcgattgtgccgtgtacaaagcctgataggcaggttcaattgcttttctgacgtttcccgttaaaaattcaaactcgcattcgcacaggtgatccagcccatagcctgctccgtgcagcacccgtgtcattgggggcactcctgcggtgaagcatgccagacttttcttcagttcacctgcacgggcactctgcaggttcagaccagggccgagatccaccagccgcagcttgttgttccagcggctgctgccattcggcagcagatcgtcggccttctgaaaccacacatcaaaattgttttcttcccgccccagcatgataagccctcgggcagcatagcattcccccaacatggcggaacccggctgcgtcttttccaattccgcctgtaccacgtccaggacggcggccgattcctcaaatctcagattgttagtcagcatcactgccagcaaaatacgggtcatgggggttttatttcggaaatgatccggcagccatttgatttgttcaataagaaattccgcctctgtctgggtatgccgggaagcctcaaaaagcagcaaaatatcccatacctcctggtagctgccgatcctgcggtaataatttattgcgtcatagtagtggccgttttcccgacaccattccgctgcccttcgataggttatgatcacgtattcctcgtcgagggtatggcgcttttcccgcaggaattccaggtacagcgggtgaaaataaaaccgcctggcactcacgttataccggataaaaagattgacgcccatcagctgatccagatcccgccctttttccccgcttacggcctgtaccagaccacgggggaacgactccagcccggacagaaggataagcagggtttgttcccgcggcgtgtactggaagaatatctcacgttcaaacatggcgaacaaacgtggtttggagacggacaaggcatccatggcggcctgtgtgccttcccgccgcattaccattttcagaagggacagagcgataggccagcccgagacataccgattgacggctgtggcctcttcaaggctgacctgcatattggacgatacaaacaaagcctgtgcctcttcatcggtgaagcacaaatcatccgcacctaccagctgcatcggcacggccgcctcgataccggcaaccggccaggaacgtgcaagcagaagcaaacagctgttttccagccgcgcggcaatcaggtttgataaaaaagtccttacctggatgtcatccacaaggaaaaggtcgtcaaacacaaacacaaccgcctgtctgtcggtgtacagattctctgtcaggtcggtaagaaacacactgaaggcttgcggactgtccggaaagccgagcagtttcattttttccgccaaggcagggtggtgcaaggcaaaggcagcggacacgctttcccaaaaacgggagggattgttgtccagggccgtaaaattataccagacagttcggtattccgatcgcgccaaataatccgcggcggcgcgggttttgccaaatccggcgccgccttgcagtacagccagtggcttttgcagagcctcctccaaaatggattccacccgcggacgcctgattccggtttcattgcctggtcgctcatccgggacagtattcgccatttcttcacctccagtcaatttgatcagcactgcagcatatgtgctggaatttattcatagtatgtccctcaatcatgcatgtattgcagatcatcgtaattttttaaaatgttttacggtattttatacataattaaagatatgaggtgatcgaatggcagctaatagtcgcagagcaaactggttcacttccaaaacaaccatggtcaaaagagcattatcaaacaaaagactgataaacagtggcttttatgatttagccccagcctatcagtctatgcatgtcaactattgaaagcgccgtgtaccaaatggcacacacggtgcggtaagaggatgggagttaatcactccctcctgcccgattataccttttgctcttcctcctccgcatccagcgcccttatgtccttattcccataccaataaatactggcagccgccccgagcactgccgtacatgaaaacatcagggccatgccgcttccgctccctgttcccgtcagccttcccagaaaagctgcggcaggagaaccgcccttcataaacggttcgaacacataatccgccagccagcctcccaaaagaatccccagcggaatgctggaatactgcagcgcatttctcaccgcaaaaatcctgccctggatttctctcggaatccggttatacagaatcatccgctgccctgcggctacaaagggaatcggaatactggcggcaagccctgccaggctccatatccacacgtttcgtccaaaactcaaccccagatccccgaacaggaaggaaaaggccgcagacagataaatcatttttaccggactgccttttatccggccggaagccacaagcaggccgcccgcgatccccccgattccaagcacgctgctcacgatacccatgatctgctcatttccgccggttcttgccagaagcatgggagacatgatattttcataggtcagcctggataagaaattgatgaggaacatacttagaatcatgtaagacagtcccttccttttcctaaggaaatcaatcccttccttcaggccggaaaacagcgcttctttctttttctcccctgtcggtttctcagggatatggataaaaataagaagcacacaaaaggcaaatacaaagctgcatagatcaaggagtatcactccttccagtccccggaaagcgctgacagaagccgccagcacaggtgtcaccaccgtcagcaggttattggaaaaggaatccatgccgctggcccttgcgtacagctccttcggcacaaggattcctatcgccactgactgggcgggctgctgaaaagcattcataaaacccgttatcacattcaccacataaatatgccatatttccagtcttcctcccgccagcattgcccagataaaaacagtgcacagagcggctgccgaatcggacaccagcataattttctttttgctgtgtttgtctataaaggaacctgccagcaagctgacaaggatgtaaggcatataagaacaaaaagtcataagagataccgtcatcgcggaatccgtctgcttatatgtccaaatcatgagggcaaagcctgtcatagcgctccccagctgggaaacggactggctgagccagaaaataatataacctgtaaatccgttctttttatttaaattcattggttttctccttatagtttttttatttcctataagtacaaaatccaatgcgggcggtatttactgctctgcagctgcaaacctctgtacaagttccgcccatacactgaaccttgtacagagtaatacatccatgataattttttcgtgtctttccatggtttcacctcttcttatatacccaacagttttttatactcctctatggaataccccatcagaagggccgaaggagcttctccggcaaccagcttcagcagctcttccacattatcatccggctcaatcccccagtcctccagcagttccctgcccatcgccaaagcagcctcaggagcggggttcagggacacctcctgaacaaaactcatcgccagcatcatacttgcatcataatctaatccgcctgacgtctgcagacaatccagcagcctcctgacagaaggtatcagtaccgaaaccccattttccaggatggcctccattttttccctgcagaatggtttgtagcctttcacaccaattctttttctttgcttaaggacataggcgatttcttcccggtcaaggatgctcagataagtctggccgctgtcctcatccctgaactctgtataatcattccataaagccgcaagagcagcgatcccttcgtaaaattcatcagggtcaagtgtatcctcctgatacatgttcagcatagagtacagatatcccacctctgccgccccatatatgtcaacgagaagagacagcagtttttccagcctttctttttcttccagacaggccttccatttttcctgcccgcagagcgctgcatattcccttccttcctttgtcagcccgattaccgcatcaccgatgttctccaaatccaccagcccgcatgcatggtacatatccatctcattcatatgcatcatacagtctcccagggttaccgcccgctcccccgccagcccggcaaggaatcggcctcctcttcctgtaaacagcttcatcatgagctctttgtccccttccaggacatcaataagagcggcggcataaacatccgctttcttttttctgttttccgcctcagggatttccatccccagctttttcagaagctttttcagttcttcttcatctctctgccccataatggacttcatgcttttcctgctgcatacgacctccacaggtttgtcaaactctgattcttcctcccaatcctcctctgaatccggatatttctccaactctctttttttcctcacagcctggctgctgccctgatcctgtccgccctctgttttcatcaatgtcacatcaaacatccattcattgtcgaaatcataaagatacagccaggtctccttcagctcccagcccaatttctcaagacatacatcattctctgtttttccgctgccgttatcagatgcatcacagcctttgggatcataaaaaacctgattccggctgaatatatatgaatgctccggggtaaaatcaaacgcctcaagtatggcataatgcagatcctccaggctttttctgccgtcgatctgtatcatccggaatacctggggcttatcccggaaccttaccataaaagtatacacttttgttccttccatagattcctcctgctagtagacaaatactggaaaactctctcttttatcatagactacaaataggaatcccacaatattttttctaaaaaaggcctgcaaaggtccctctcccatccggcaccggcagtgcctgaatggaagacagaactttcacagcccctctccgtcaaattccggtataaaactttcctctgccgtattcccttcctggataaacccgttttccactccgatatccagggcgtaatccacaatcttttcgtattcccgggcagttatcctccgattcagttccggaaaggaggataaatcacacaccggtgtaaactggttcataatgctgatgtaaatcctgtccccataggtatggtaaagataggatattacctttttggaatctgccgtacagcccggaagaaccagatgccgtacaatgactccttttttcataagtccgcttttatcatcaaaatccggttcgcccgtctgccttaccatttccgcaacagcggccgatgcggtttcaaaataatcagccgcatgggaatacctctctcccagccgggaagacatgtatttcagatccggcagataaatatccaccaggccttccatccgtttcaaggtctccacccgctcatagcttccggtattatatactacaggtatgtgcagtcccccaagctttgcccgttccaatgccagcgcaatttgcgggacaaagtgagttggcgttaccagattaatattattcgcttttttatcctggagttccaggaatatttcagacagccgttcccagccgattatcctgccggctctgctctccgcaatattatggttctgacagtatacgcaccgcagcacacagccgctgaaaaacacggtgcctgatccggtttccccggaaatgcagggctcctcccaaaaatggagtgccgcccttgccgccatgatctccgccccctgtccacagtagccccttcttccgccaagcctgtcagcatggcagtttctggggcacagtgtacaatccttcattatctgttcaaattccgttactcgattttccattgcctgtccctatccggatgatttttcttatcatttcctatgtcatttactatacgcaatggaatccttttttgcaagactgctatgctccgatcaagccagcccgggcactatccagaagttctcctgcgctgtcatgtgacagctcccatattcctacccctgccagaccgagattcctggcaaatgccgccttggtcccgatggaacggggattttcataagaaatgaagataccgtttccgtacagatagggtaccgcggccccttcatggtaaaaggaagagaatgccgggttattcaggtaggttcctttaatgttattatagctgatagaacgtgcggatgaaaaagtactgtatcttccttcctgagccgctcccaccccttcataaatatagccataaaagggcattccgagaacaagcttgtctgccggcacacctgcattcagataggcctgaacgccgtcatgcacgctgtttttatattgagggcttctctcctggggattgtataacggcgctccaaaatccgaataggtatcccaggatccatgcatatcataggccatgacaaaaatatgatccaccagccccactacctgctgcgcttctatcttattcagataattggaattggcagcgcctgctatggtgagataatattttttgccgtcccgctgggtctgcgcattcagctggttcctgatggcggacagcagaagggtgaaattacgtttgtcctcccggctgttgatattcccagccggtcctccggacacaggatactcccagtccagatccaccccatcaaatccatgggtgagtataaaatccacacatcctgccgcaaactggttcctgctttcctctgttgccgccacgacgctgaaatatgtagaataatcccagcctcctacggaaatcagcgtttttaatcccggatatttctttttcatatttctgagctgttcaaaatttttcagatctttttccggattagccacagctattgtgttcgctgcaggatctatcttagcgaaagcataattcagatgagtcagcttccctgccggaatatccgccggattgtagcctttatcggaagaccagttggtataatacccaaccaccgtatctcctttatttaactttgccggagcagcttctgttctcaggcctgtacctgcaagaaacaaaacggctgccgctatcagggaatgtgcaatattttttttcttcatatgcttcctttcttaaaaacaataatatgcccgggggtctgtctttccggcacggaccctcaggcataagtatatagtcaacatataaacgatacaacacacaatatttggcaataaccaattaacccttaacacttcccgccgtcagaccggcaacaaagaacttttgacaaaaaataaaaattatcagaatcggcagcagactcagtaccgaaagggcgaatacgtagccccactgggtaaactggtgctgtccgaaaaatccggatatggctatgggcagagttcttttcaggttgtcatttattaccgtattggcccatggaaactcttcccaggccgtcaggaaattgaaaatggataccgaagcgattcccggcttcgccagaggaaacacaatccggaaaaatacggtaaacacaccccctccgtccatatatatggcttcatccagttcctttggcacgttttccacaaaacctttaatcataaaagtggaatacgggatgacccaggccacgtaaaagggaatcagtccccacaggttattgatcaccttcagctttaccgccagctcgtactgaggaacgatcagcgtggtgccggggataatcatggtgagcataataaataaaaagagaaagctccttcccggaaaacggaagcgggcaatacaaaagcccaaagcggcggccacaaatgcggcgatggccacagtgatgccggataccagcacactgttgagaaaattcatataaaatttcccctgatgcaatatgtaatcataattctccagtgtaatttccttaagcgacgggaaaaagtgcggcggaaattcatagagtgccccattgggcttcagcgaggtgcttatcatgtagcagaatggtattaccacaatcaccaggccagccgtcaaaagcagatacaacagaaattgcacggcatttctttttgtcagtttcattttcaatcctcccggctttccatgcctaattcttgctgcgcatcagccggaactgaaacagagccagtatggcaagaaccacagccgttataaaggacagcgccgcagaataaccgaacttgcctgtgctgaaggctttatagtacatccaggtcaatatcgtatccgtctgatgtcccggcgcgccgtcggtaatcattttaatagaagtaaatacattgaagcccccgatggtaagcatgaccagcgcaaacaggaccgtcccccggatggagggaagggttacggagaaaaattttctcacgctccccgccccgtccagagaagccacctcatacagctcctgaggcactgtctgcagcgcggccagaaataccaccatattccagccgattcctttccatatgccaagaagcatggctatggtcagccctccccaccgggtatcaagccaccggatattccggctggtcacatgaatgatatcggtaaggaaataattcagcattccctccgtattaaacacgtatttgaaaaccagggaggcaatgacccaggacgtgataaccggcagataatacagcacacggaatccaatccggaagtggccgatgctgttgataaacagcgctgtaagcaggccgagcagcatctgggccggaaccgtcaccagcgtatatacgatggaattcacaaataccgtatggaaatatggatcccggaatacttccccatagttggcgaaaccgataaattcctgattcagtatggagccaaaatcccacttgaaaaagctcataattaataatttggctataggatacagagtaaatattccgaaaatcaatactcccggcagcaaaaggagtccgatctgcatcctgctgccccatgtttttctcatcatccatgtctcctttgcgcattgccgcagtacagtccgcgcaccgtgccattgacgaagcggacagacctggtctataataaatgaaagcagctttgtccggttatatcattcagccagaagcacgtccattttaaccgccagctcatccatggcctcccgggcggtcttatccccgttcatcacggctgttacggctgtggcaagttcgctgtcaatttccgaccagctggctacggtaggacggcttttcgctgtttttatagcatcgatgaagggcgcgaaatcagcctcttttaccgtatcgctttccagagcttcttcgtttacgggaatctggccgcattttgccatctcttcctgagcgtagggcgacgtcataaactgcatgaatttccaggctgcttccttattggcggactggaacatggaaatatcctctcctccgagaacggaaaccgaaccgccctttcctgcgggcataggcgctgtcccataagcaaaatccggatatgctccctgcatttccgctattttccagggaccttccagcagaagcatgtaacggcctgtcccaaagccatctgtcatgggaatatcaccgctgttccagccggtaatcgctccctgggcgtataaatctgccagcatttgaatggctcctacggtttcagggctgttaatatagcctgaagctttcgtctggccgggatcggtaagctccccgccgcagctccagataaaaggacacaggttccagcctgccagggccggttcgttatatccccatacctgctgcccattttcattattacctgaaagcttctttaccgtatcgacgaattcatccatgtcggccggaacgggaagtcccgcgtcctccagggccttttggttataaaaaagaattttggtattggtgttcaacgccagaccgtagaaatgtcctccaatctgcgcggtgctcatggcactgtccagaagaccgccggatacggcgtcaaaatcagccatttcttcatccagcggaagcaaaatccccatcttctggaattccggaatccaggcgctgtccagacgcgccacatccggcagggtatccgctttggcattaatcagaatcttatcgtgcagatccgcccattcatgggaaactgcatttactttgataccggggttttccttttcaaattcgggaatgagcacattcatcagtgtttcattttccgcagactgcgcactgtaatggtgccagaaattgattgtgacctcatcctgtttttgtgttgctgactcgctgctctcagtactgttttgcggaccgtcctgtgagctgctttcagaatttactggcgatttaccacagcctgtcagagcccccaagcttaatgcagctgtcagtacaattgccagtatttttttgttattcttcataacctctttcctccttttctttttccatgaccaaaacggaccactctccggccatgagttccagccttccctgacagtccatccggtcaccgttcacaccattttttcctccgtcctccgcccatcgggcgcggattgtttttccttcctctttctctctgtctgaaaaaataatcttatatttccccggagaagctacaggaagcaccgcttcttttttctctcccgcgttcagaagcacatagagttcttcctcccccaggcttctcataaaaccataggttctgccttcacataagaccgccgtaaagcttcccttcctcagaacctccgagcccttccgcagtgcggccagcctgcggtaccagcgaagcagcttttcatcctgtttttccttttcccagataaaagcccccctgcagtccggatcattagcccccgtcataccgatttcatccccgtaatagataaccggggaaccgggaaatacaaactggaaggccaccgccagccgaagcctgcgcttatctcccccgcacagatacagaaaccgctccgtatcatgactgtccagcggattatacagagcctgctgcatctcttccgggtattccgccagcatatggttcagccgcccgtcaaaatccgcggcatctatgctttccgccgcgaaaaaatcccttacgctgtcccggaaaatataattcatgatactgtccatctggtttcccagcatcagcttcctgccgctcccccaggtttccccaagcaggaggcaatccggatatttttctttaagaaaggtcctggcctgcgtccatacgctgccatccacctcatccgacacatccagccgccagccgtctatatggaacttatctatccaatagtccataacgctgaggacaaattccctcacctccttgtttgatgtattcagcttcggcatccatttataagcgcccacacattcatagctgtgatgggaaagcgtaaccgggaaatctgtcactataaaccagtccttatacggggaagcctcctgcttctccagcagatcctgaaagggcgggaaatggattccgcagtggttgaaaactccgtcaagtatgatacggattccttttttatgacaggcatccaccagctgcgccagttcctctttggtaccgaaggaaggatccacctcaaaataatccgtagtggcatatttatgattaaaatctccccgaaagatcggtgtaaggtacagacactgcacacccagctcctccaggtaatccagccgggaacggattccccgcagatcccctcccatataatgatccctatccggtgcgctcccccaatccacgcagccctccggatcattttccctgtctccgttgcagaacctctccggaaatatctgataataaacctgacctttgctccattcaggaatggtgagacagtccttttcattcgcataaagaaattcataaaaaccgtcctccggaaccttttcctgaatcccccaggaagtcagatacagcttttcgcctcccttccctaccaattcgaaatagtatttctggtatcttgccactttggaaaacggcacctccaccgtataatagtccgcctccttatcgcggaggctgcaggtcatacggaatttccgtatcctttccggcgttgtccttgcgtaaacagccaggctgcattccgccgcatcctctcttgccgtccgcagccggaagcttaaaaggcttctgtttttggcataaatgtccggcaggatacaggaatgcagaatagctcccctattcattcacttctcctctccgggaggattcacgtatcagcagcctggtggatatcagggtttgctgattgccgctgtccgccctctttattttatgaatcagctggaaggccgcctgttctcctattccaaaggtatctacatccacagcggtcaaaggcggatccatatattgagcaaaagggtaattatcaaaggtgacaacccctgtttctccgggtacggaaatattctttctttttaatgtctgcagcacatgataagcgatcacattgttggaacataagaaggcatccggccgcttttttccctcaagcatatgctccgttatgcttcctccctgctccggctgtccgcattctcttatgaaatccgtattttcttccagtccggcagtcctgattccttccagataaccggcaagacgtttttccgcaaatacggtattcctgttttccagcaaaaatgcgatccgctcaaagccctctccggcaagatggagcaccgcctccttcgccccctcttcattattagcgtccacccagcatgcttcctttttcataaccgccggttctcccaaaaccacaaacggacattcattcctcaacagcatctccaccaggccggtacgcacacaattggaaggcaggatcagcccgtccgcctttttctccagaaccagcttctccacggcagatacacccatactgctgtcatcattggctatcagcagattataaccgtttgcctgggtcactttttcaatggcatatacacttctgttaaaaaaggtattggaaaaagttccttcgtcccttgcatccataatcaggcctatacaaaaggtgcttccattcaccagattcctggcaaggctgttcggatgataattcatctcctccatcacctgcaggatcctgctttttgtctcttcagaaatcgatgcgctcccgtttaccaccctggaaacggtggatggggccacccccacccttttggcaatgtccttgattgttacgctcatatgtactcctctcattagcgcaaacgtttgcacaaaaaagtaaaaaaaatatgattatttatttttaatatacaattttatttgcgcaatcgtttgcatatataaatcatattctatatcaatttccctgtcaatagaatctgtaaatgatttttaattttggttattttccattaatcgatttctttatttttgtgtatttttcattacgtacgtttttatataaatacataaaaaagcgccggttcactccactattatgaaatgacctgacgcaatccttttattaaatcccggaaaaaccatccttataaaattcaaagaccgtgcgtcctgcttcgaacataaacccatatgcgttacctttacagttaactccgccaggcaccctcacggcacacggaaaattctgcttagtgctgctttgttcccaacctgacacggttcgcagacatccgttgcgtaagacccaaacttcaacgccacttataaagggcagccacacaggcacaagccctaagccggacatcacccctgctatagcggatttcaggtacaggggaccgctaatcccccggctgcacggtctaattagtatacttttttttgaacgatttgtcaatccttttggtttttggcacagataaaattttgccattcatgccggtattgcggttactcctccagcacttcagccacctcttctgcagtaatttggcatatttccgcaatttcttcttttttctttccctcggcagcaagcttcagaaccctttttgttctgcttatacctcacttccatttgattcaagcatccctagcatatcacaatataatttataattactgtaaatttttcaatgactcttcaatttcggcaatcgtaggtaaagaacttacataatcattaggcagcagatcttttaatttatactcagaaataccaattggttggctgcttgcctctaatgaatattcagccattatatcatcttttgttttacatatcagaagtcccagtgtctcattatctgtttcctttttcttttgtaaggtttcttttgcaagatcactttgtgtatcaggtaacaatcttgaaaaatttgttattgcctttccctgtcgttcaaataatcccgtttccaaaaagtttaataaaactgctctgctccagccattttccaatattttattaacgtaaaaaaaggcttctcttacagtcttgcactttgtaattaacaatatttgatggccccagggaattgaatataatttttcaaattggtcaacaggctgttgaccaatttcatcatcattcgaataaaactgaaaaaaacgcttcatatattttaaatttgttactgaaaacccttccattcccggaaaagcatcttttaactcactgctcattgtagcaaaaattttacttccccactttgcttcaatatctctttgaacaatctctttacctatatcccaataaagctgcagcaactcagaatttacgtgaatagctgctttgagctgactctgtttaattatctgttttagtgtttttatccattctctgaaatacgaatcgttaaatatctttaaatcctttggcaaaatgctcacctctcttaattttatcttattttcgataattttttcaaccgttacaatcaaaaatcaaccatgagcatacctccctccccttatattcactatttcaaatcggaattcatcggcagacctgccatgacatctatagattttgagataaaccaattataacacacatgcaaagatataccaatacaaaaactatttaccattatgttttttttgataatacattattttgaaattaataagaccaaataaaaaacatgacaatcagttgtcatgttagtcatgctattcttaaacccaagggaagaaatcgttcatgtaaatagaatctggagagagtcaaggttttccattctaaccgacagggtgcatcgcatggcctgtcagtgaacaatacagaaagggttctgaagaaaaaacaaagttgacggatttatgtttaacatccatgtacccaaagaaccggcagcaggtgaaggaaaaaccagcaccgctgccataactaaaatcgtacgcattattgaggaggcataatcatggctaatacacttattttcacagataccgttgattcccgctgcggcctgcactgtaccggctgcacctggaaagaatcccatggctgcaggggctgtatccccacaaacggcaacccctttcacggggaatgtccggttgccgtctgctgtcaggaaaagggctttgttcattgcggacagtgtccggaaatcccctgtgatttactcacaagctattcctgtgatgaggaaaatggagactctcccgtgggcgcacgcatagaacaatgtaaaagatgggccggaaaagcataatttacagcctgagaagctgtcccccctttacttcccttttcccgccgtccacttcaatccatagggaggctgcagaaggattgtataccatatccccacctgccccgaactgcagccggccggcggcctccatataatccacgatttctatattggacgcataccagatatcctccctgcctcccatacgccggcagaaattctccataacctcccagttatcatgatcggtaaattcatagctgtgtccccatacatacatcatataaagatactgggttttatgcagagccgcgaattcgtctcccagcttaatgagattatggttataatggcaggtcgccttccatttcaggaaatcctccggcatggcaaatccgtttgtctcttcaaccgttctggaataacggatgccaagcgccggaagaattttaacaatttcctcattataggaaccgttcggataagaaagcccccgtaccggatatcccaccgccgcttccaggtttctgcgatcctccagaatctggctcaccacctgctccatgggacacctggctatcgtgggatgagtacaggtatgacaggacacctcatgccccttatacagctcccggtattcggaaacaggcaccttcttttcatccctgattgccgaatttacatgaaatgtccccttgattccgtaacggttgaaaatatccaccagccgtctgtcctccagccttccatcatcaaaactcatggtgagcaccttgtgctttccctccggaaaacagatataaatattcttcattccttcctttaccatacccttgtctcctctcttcatcagccgagcttactccccggtattcataatcctctccttcacgggcaactaccgccgcattatccattagcagtccatcagccttacaagagccgcagtacagtccgcacggtttaccttgctctccctgcagtatccgtcccacagcagtcccagtcctgccgccatctcctcgcatgcctctatttccatattccgctccgtttccggctgaaggcttcggaccataaagcttaccagctccccgcaggtaaggccgtcatccggacggaacctgtcctccggcgtggttttttcatcaatcagccccgcatcccatgcggcctggacatttccggcgtcaaactcatatttataaatgtcacaataccgtccctgataagatctcccggccggaaccttcacggctttaaagaacatatataaaaactgtcctctgggcatttcgtcaaagggatggaaaaacaagatacacggatccagcaaacctcctgccatggctttcttcagatcctgctcctgagggattcccgagcagtccgcatagggaagctcaggcaagtccgtaggaagaacgggccgctcctctttcagctctgccaggcgagacgaatgctcccccggcatctcttctttcgggtaaagagacacatccggctcccaggcttcgccggcataatcattcatacccgcgcacagcggttctatctcaagcctcctgatttcttcactgataaattttgccgccagcagcgctccgtaatcgttggtatgggtggtatccataaaataatcgggataggtatccggccccatatcacaccaaagccggaagctgtaagaatgcagatcaatgaccggaaccttcagctccttccccacccttcggcagctttccgcataatcctccagcaaatcaaaaaatccattctcatcttttcccggaaccctgctgagagaggtaacgattacagggaacgctccttttctgcgtatctgcagaatataccaccgcagattggaggcatattggtcaaaagccttcagattccttctcttctggtcgttatgcccgaattccatcatgaagatatctcccggctttatattttcggaaataatattccaatgaccgtcatcccggaaacaattcgtagtcaggccgccatgggcctgatcgctgactgcaattctgttaaaatactgaagcatattctgcccccagcttccgaaattgcgtatgggattataaggatataacccctcataatcggttaccagagaatcccctgcaatatagagaacaggacattctgcgggttctatatgaacacccgtaagacgcgcccttcctcctgccctattcaataccgtcacatatatggaacggtcttctttcggccctttacccacaatggggatatacggacatacctgtacataataggttacggtgaattcttctcccggcataatttccagatcccgtttcaccaggtttcgccttccggaataaagcatcaggccgctgattccatcccttccgccccggataataaccgtgaccgcataggttccattttcaggaaccgacgcccggaaccgcaggggaattcccgctcccaaaagctctgccccgtcttctgtatcgtacagggaggctggaaaatcctgctttccttccgcctcttccctcagattccagcccccggttccggtaaaccgatccgcagataccgaggtcgtactgcagtccagaaaaccgtatcctttctgttcctcatataaatcatgggatgtaaccctcaccccgtccccattttcgatgaaagaaaataatctgccggccataaaatcctcccctgcttcttataaaataaatcctgtttcttattataataagtcaattattcttatttttcttttattatattgctgtttatgagcttattttgtatactattttagatatattaacatttcgtccctgatttccggttcattgacggacagggtatttaccggataatccggcaagggaggccgcccccatgaatgctaatcttcattccccggagcatatgctgcaaatcgaatatataaaacatcctcaggattatgacatgggaagctttcactatcataacgcctatgagcttctgtttctccaggagggagaatacaccctgataaccatggatactgcctatacgatctgcaaaaaccaggtgtccctcattcctccctgctgcatgcacaaatccctgggccgggcgggcaatgaacgtacgctcatgtattttgacgaccgctttctcaaccggtattttacggaaaaaagccgctcccttcttttatcctgcttccggagcggacagctccctttatctcccgaagccttctcagaagcccttgccctcctttttcaaatccgtggcttcgtccataaaaatgattatgatgccgcctatcccgcctttgtgagaattctgtccctgcttgatgactcctgccgggaaaatattcttaagacttctgatgcggaaaaaaagagaggtacggaaaatccccctctcattgcagaagtcatcacctatattaatcagaattacagtacaatccggtgccttgatgatatttcctcccatttttatatcaccaaatatcatctgtgccgccttttccgcaatgccaccagcagtacggtcatggaccacctgaacagcatccggcttttccaggcctgccgcctgctggaaaataccagcaaaagcattacggatatcagttatgcctgcgggttccattcctccgcctacttttccgatttatttaaaaaggccctgggcatgtcgcccagagcctatcgaaagctgaaatcctgatatttgtcacagggtattggccctgtgttcaatgtttcttttgaagttcacgatctgatgatcatattcctgatccataagagtactggttattaaaaaatcagcagtagccctgttattggcaattgggatatcataaacctgggaaatacgcagaagcgccttcacatccgggtcatgtggctgtgcagtcagaggatcagaaaagaaaataacaaaatcaatgcgtccttccacgattctggccccaatctgctgatccccgcctaaggggccgctgttatagcctttaacaggaagtcctgttttatcggtaatcatccttgccgttgtgcctgtaccgcacagaaaatgatttttaagtacgtccttatgctcttcgcaccagctgataagctccggcttcttgctgtcgtgagcaatgagggcaatatttttctgctttccaattgtgagtgttaaaaactcttcattcatcataaacgtttcctcctttatggacctacctgcccatatacgtttgtctgttttttctttcttcctacgtttcccactatacaggaaagatccggaaattgcaagaggtgttaaagggggattgtaatttttacgtttgttcccttgcccacgcagctatgtatgaccactccataatccgcaccataggcaagctgaattctttcatttacattatatatcccataccccgcctccggctgtccggaaagcagccgctccattttctcctcctcgattcccgctccgtcatcttccacttcaaagcatatcctgtcctcctcactatacaggcggattatgatatgcagcggttcctcccgttcacatacggcatggttgatggcgttttcaataaagggctgaagcaccagcttcagggtcctgcagggaaaaagtgtttcatccacttcgtagctctcacggaaatgatcccggaacctcatatgctggatcgcaagataatgccgggtaatatccagttcattttccacagtgatataacgcattcctttattcagtgaggtcttataaaaagaagaaagatggttgatgatcccgctgatttcctcatctcccttccggatggccagagaggatattacggacagggtattataaagaaaatgagggttaatctggctctgcagcgcatacagctccgtatccctgcgggcgatttcctttttataaagctcatttatcaggatgttcagtttatccgtcatccggttaaaggactgggaaagccgcccgatttcgtcattgcccttaatatcaattttccggctgaaatcctccttttcaatcagggcgatctgtcctgtcaggttttttattcttcctgtaaaatagcgggaaataaaaagaatcagtatgagggccagaataaagctgatccctgctatgagcagaaccctgctggatgccagctttgtttccctcaggatatcatccagcggcacaatggacacggttttccacccctgatccatctgattgaaaacgaccagggaacgtttcccccgcacatccatcaccagccttccatcggtatcctccatggggatttcaacccccagcacttcccccagcactttcgagatcaggcttttatccttcgtggaaagaatgcttcccttttcatctatcacaaaaatacttttcccctctgattcctggcggatcatggagtaaagatattcctccttcacggaaagggtaagcaccccatagggataattcaggctgttgaagttcataatgcgggccagtgaaaaaacccgttccttcttatcatttaaagtaatacctgtatagactacattcccgtaagtcctgtcaagctccctcacccaggccggggccgccttttcgtcatacagatatttgataaaagtaccatccgtaggtattgtgtcattgagtacataaaccgtgatcccatccacattgctgtttgcagccatgagtccgaaaaacaaatcattaatgtagccgtaagcctccacaaaatcaatgtccttctcatatgtctgtgtcagataggccttcagtgtggcgttggtataaagcatccctgagatctggtgaaagttctccagctggccgctgatgttattgttgatctgctggttcatatgattcatgttttcataggcctgttcaagaagctggttcctggccgaggtataggaataaatggatattaccagaagaggcaccagggaacaggtgatgagaaatatcagaagcttccccatcatgggcagattgtaaaagaataatttcagtctgtttttcataaggctccctttcctgtcagcttactcctgaactggttgggcgtcactcccatctgcttccggaatacggcgcagtaatgggaggggttttcatagcctaccttttttgatatatcgttcacccgcatattcgtttctttcagaagtaccaccgaacgttccatacggattctcgtaatatattccagtatggtttccccggtataatccttaaacagcgtcctcagataattaggggacatatataccttctccgccagatattccattgtcagaggttcgctgtactccttttcaataatctgtctcaccctgtttacaatttccagacgccggtcaccggataaaccggacagaatatccgttattttctccagaaactgctccagaatttctctgagcagggatattccctccgcagcagaaaggaggccgtacagctccgctttatcctccatctgctcttctacggcggaattcaccgcgatcacggaggaatatattttctctgtcagttcaaaagcgcctttcccgattccgccttccctttccgaccattccaaaaaataattgtccagccattttttgatttcttctttttccccgttctgcaggcaggcaatcaatgtcccgtattccgccggtttttccttttcctgagacttccttgcttctttctgcccgtcacagaggattatatgcccggaaccatacatctttacatgccattgccggaaccggctcatttcctggcataaaaccggcatttgctccaatggccggcggttttcatacagacagaccgtaatccatctcgccgcttccttctgctgctccaacaggcgtgacgccgcccggttcaattctgtaccggatagcagcaaatagctgtaatcattgatatgcaggggaagtatcctgtcatttgacagcctgcggatcgcggtatcaatggtattgaggatatcctgtccattggattcgtagcctgataaaaaacgatattcatctattgttatcattcccacataaaaagaccggttttcctgtccgcagtgcagaatcgtattacaggaacggcagatatcttcccataatacctctttttctcccgcactgaagccgagaagattccgaaaattctccgccgtaaccacagcctgggattttttctcccggaaggatcgggaacatttttcccttaccttttccatcgtgcctttcagttcctccgtatttaaaggcttcaatatatacccacaggcctccacagccaatgcggaacgcacatattcaaaatcgttgtagccgctcaaaaaaacgatttgtatatccggatatctgtcatgcagtattttgctgaaagcaaggccgtccataaccggcattttcacatctgtgagcaccacatcaggaagcttcctgtcattctccccttcgttttcagagccttccaatctctccagaagctgtaaggcctctttcccgttttccgctgttccagccacctgaaatcccatttcctcccacgggatatacttttccagggtatccagctccagccattcatcatccaccaataaaatacgatacataccattcccctccctcaaagccttctttcacacatgaatcatataacataatttatattatttcaattattcagcccctaaattcgtacgtttccgttatgaatcggtgatatccgttatggatatgttgtgtattattccctataatcaaggcataaagcaggaaacaaaatacatcttaaccaaggagggggttttattgattcaacaaatggcagtaaaaaccaataacagaagggagcaaagaaaagtccgggtccggcttatgaaacgccagcgtaccctgtacctgatgctgatacccggtattctctgggccttactatttgcttatgggcccatggccggcctgtatatggcatttatcgattatcagccctccctcggcaatttctggtccaatttcttcgggagtgaatttgtgggcctccggtggttccgttattttttctccggccaggatttcttaaatgtacttcgcaacacgctttgttccagtatcctcaccctgagcatcggatttgtgattcccatattcatagcccttgccctgaatgaagtaaggggacgctttttcaaacgggtagtacagacagtttcctatctgccttattttatatcctgggtaattgccgccaatattatcgtaacccttctgtcttcagaaggccttatcaatcagattctgatagcctgcggtttcattgatgaagggattttctttttgcaggagggaaaacgtttctggctgattgtggcgttatccaatacctggaaggatatgggctataattccatcatgtacctggccgccatttccgccattaatcccgagctgttcgaagccgcccaggtggacggagccggaaggctgaaacagatatggtacatccttcttcccatgctcaggcccactatactgatactgctcatactttccatagggagcctgctgaataccggttttgatcagtatttccttctgggcaattccctgaaccggcagtattctgacgttattgacacctataccttccgttatggtatccagaatggcatgttttcttacgcctctgcggtaagtatgtttaaatccgttatcgccttcctgctggtactcacggtaaacactatttccaagaagctggaaggcagccaccttttctgaagcaggctttcttagaaggattacgaaaggagttccttatcatgcagaaacaaagatcgaaaaaagccgggctgccgcatctgacgccgggtcagatagccggaaaggcagttgtttacggatttctgatttttatatttatcgtcacctttttccccttctggcagatttttgtactttccattaacgatgcgggagattccctgcggggagggcttctgctgtggccccggcagctgaatctgagcagctataaagccgtatttcagaatgaagaaatcctttcttccctgggtgtcaccgtggcccgtacggtaatcggcgtacccctcaccgtattctgtgtcgccatgctggcttatgtcctctccaagcaggagctggttcacagacgggctatcaattttttcttcgtgtttaccatgtatttttcaggcggattaatacccacctacatggtaatcaaagccctggggctgatagataacttttttgtttttatttttccgggcatgatcaatatctactggatgattctggtccggacctatattgaaggtcttccgaaagagctgtttgaagcggcctccagcgaaggagccggagaatttaccatatttttaaaggtggtgcttcctctcagtatgccggtgctggcgaccatcctgctgttttccgctatctcccactggaacgcctggtatgattcctatatttatacctataagcctcagctgaaaaccctgcaggcggtgcttgtaaaaatactgaaccagtatcagacaggcgctatggtttcacaggcccagcaaatggcaaatgaagcaaaaaaaatgccggtcagcagcgaaagtatccggatgacggtaaccatggtagccacgctccccatcattctggtatatccgttcctgcagaaatactttatcaaaggaatgcttataggagcagtaaaagactaatttaatataaaaaggcgctcagcgccggaaagaggtaattatgccaaaaatcacatttatcggtgccggcagttccatttttgtcaaaaatgttttaggggactgcatgtgcacaccagcccttgccgaatccaggctcgctttgttcgacatcgatgaaaagaggctccgccagtcggaaactatgcttcggtgcctgaaccagaacctgggaaaccacgccagcgtggaggtttaccatgacagaaaggaagcgctgcgcgatgcggattatgtcatcaacgctatcgccgtaggggaatatgatccatatattgtatcggatttccagatacctgaaaaatacggcctgtatcagaccgtcgccgacacgctgggaatgggcggcctgttccgcggcctgcgcaccattcctgtcatgctggatatcgcccgtgatatggaggaggtatgtcctgatgcatggctgctgaattatactaatcccatgtgtattgttaccggcgccgtacagcaggcggcaaatatcaaatgtgtgggcctctgccacagtgtgcaggtctgtgcaaaagaattgctggaagggctgggaatgccttctgatgatatcatttaccggatcggcggaatcaaccaccaggcatggcttctggaaatttcccggcacggaaaagatctttacccggaaatccggcagaaggccctggcacggacggacgatcataatgataaggtcaggtatgaatttctgaaaatgtttggctattatgtgacggaatccagttcccatggctccgaatatgtgccatactatcataagcacagatatccggaattgaaggaacagtatcatcttccaaccgacggatataaaaactgggccaacgggaaggctcaatactggaaagaggtcaatgatctgatcgaaaaccatggcctcactcatgagagaagccgggaatatgcttcatatattatggaagccattgagactaaccatccttatgaaatcgcgggaaatgtattaaatacaggcttcctgattgacaatctgcctgagaaggcctgtgtggaggttccctgcctggtagacggcaatggaataacgccgactcatttcgggccgcttcctgaacagtgtgccgctttaaaccgtacaaatatcaatatgcagctgctctccatccaggcggcgcttacaggcaaaaaagaacatgtatatcaagcggccatgatggatcctcatacctcttcagagctttccatcggggatattgtcaaaatgtgtgatgaaatgctggaattcaataaaatatatttaccgaactttaattaagcagggaaaagagggatattatgtttaagaaaaatttaagtctgctgctcgctggtatactgacaatttcctgtctcacagctggatgcgggaataattccggaaacgggggagaatccccggcagcaggaaacggggattcccaggcggcagccacggaaacgggaaaagcggatgaggccgcttccggggaagtcattactcttacattttttgataaaaatacgggagatgccttcgataacccggtggctcaggccattacggaaaaaacaggaatcaagattgaagtacagcagcctaccggtaatccggaagaaaaactgaatctgatgctggccagcggtgatcttccggatattgtccttatggacaggcgaagtgatatcgtaaataagtacatcgccgctggtgcactggtgccgctgaatgatttgattgatcaatatggagccgatatccaggaaatgtatggggatatcctgaataaaagccggtatgaggacggcaaaaattattatctgaataactggtatgggttggatcccgatccggatcgggctttctgtatccgtatggatgttctgaaggaactgggatatggagagaaggcggaaaaaggggaggccttcactcaggatgagttccgggatatactgagccgttttaaagagacttataaggacgctgacgggcagtctgctattcctcttacttccaacgcggattatatgccttctgttttaagtacttttaaagcgatgtatggaatgaagaattattatgaaaaggatggaaagctgtattttgatgtcagggatcctgattacctggagatggtaaaatatatgaacggtctgtacagggatgggcttcttgataaggaatgggcggtaaataaggagcagatctttactcagaaagcgggaagcggacgtgttgccgccacggtagggctttccagcgacggaaaccggcttcttaaggaggataacggagaggatacggataagcagttttatatgttcaaggttgtggcagacggtgtggatccggataagactactttcagccccagaagctccctgggctgggatgcaatcggaataaccgtaaaaaatgagcatccggtagaaaccattaaatttatgaattttcttgcgagtgaagagggacagtatctgttgatgtggggaattgaaggtaaggattgggatatggaggacggtaagcatgtgcctcgtccggaaacgcttcagggctttaaggatgactggaacacttttgccaaggagacaggaataagaaagtggacatggtttattaaaaacggatatggcagcgacggaacaccttatgatcttgctacgaagtatgagcgggacgctgtgagcacgcatgctcttacatccatggctaattccacatgggatacggctccttatgattatatagggcctgcggcaggtacgccggaagccttgtcggaacagaaaataaaggatataattgacactgctttcacgaatatggtttatgcggattctgaggaacaggtggtatcgctttatgatgccatgatcagtgaaattgatgcgaatcaggcttctggtattgaggctgtttatacggagaagtataatgagcagctggctttgtggaaataaagggatgatggaatagaaggatgggatgaaggaagggtactccgggccggggtgcccttctttttgcgtttactggttctggctgtttttctgcttgcgttccctgcgttcttcttttacccgtacgcgcagttctttgaagaactgggtaagcatgtcgctgcattgttgttcgagaatccctctggttacttttacctggtgattgaaggcggggttttccaggatgttgaggatggatccggcacagccggctttggggttcatgcagcctatgactacctccgggatgcgggcctggacgatggcgccggagcacatctggcagggttccagtgtgacgtacagggtgcagtcttccaggcgccagtcgcctatttttttgctggctttgttgatggctgttatttcggcgtgggacagggtgtttttgtcggtgttgcggcggttatagccccggcctatgattttgtcctggtggacgatgacgcagcctatggggacttctcccagggcgtaggctttctttgcctgggtgagggcggctttcatgtatttttcttgtggggtgatgggtggggtcatggggggtgggggtcctttctttgggttgtgctgggtgggtgggtgggagtataatgggtggggaatatagagcttggcgggctttagggtggattcccgggagtccgccgggtacagctttggaatgcttcgcatgccaaagctttgcggctgtcgccgcatgtcggtaagaatatggaaaatcgttggtgagcaagctccccagcggttttccatattcttaccgccgcccggctcttagatagtaaatgatatcaggaaagaggataaaatgcaaatatttgggtttaataagactactttgttggattttccggagcatgtggcttgtacggtgtttacgggtgggtgtaattttatatgtcctttttgtcagaatggggatttggtgcttcatggagggagtctgcctgttttggatgaggaggaggtttttggggttctgcgtaagcggaaggggattttgacaggtgtctgtgtgaccggtggggagccgactctgcagagggatctggatgtgtttctttcacgggttaaggagcttgggtatctggtgaagctggattctaacgggtatcggccggaggttctgcagtcgctttgtgagagggggcttgtggattattttgctatggatattaagtcttctcctgagaattatgccaggactgcgggggtgaaagagctggacatgggtcttatccgggaatctgtggattttatccgttcgtgcggactggattatgaattcaggactacggtggtcagggagctgcattcccccggggattttttgtccatcggggaatggctgaaaggctgtaaggcttattttctgcagtcttatgtggagagtgaaggggttatctgtaaagagttttcttcctattcaaaggaagaactggaagaattcgtcatgcttttgaagccttatatcgacaacgtttctctgcgtggtgtggattgacacagcttttggggatactgttttttttcccgcagcttctgcgtgtataaaaacggtatccccgatgttttcatatacggacacttttcatataatagccgaagcttccgggttcggcaggagtctgtttcccttcaaaggcttcgaagccgaacatttctgccgccattttttccctatcatagtatactcccggtacgcccagataatatctatcttcatcccctgtcttgaattttcccagaattatatggcggtaattgtagtagccatggagaagaaagctgttatgtaccattttctgatgttccgaggccaggatcacaaaatctctgggggttatggacaggtattctctttcatccccaaaaggatggattgtggaatatatatggcacagctgctcccatttatcttcgaaaaattcctcctgcatgggatcctttatttcttccttctgtgccttgtccgtcgttacgatggaagcaggaatatgcgtagtttcctttttttcttctttttccaaaggcacgtatttcctgtgtaagcatctcctgcacagcttttctgcggaaagggagccatcttccgtcaccggcatttgggaacggctgtcctcactgtagggaaccggattctccggcgctgtccataccggcatgggtttctgcggaagttccggcttttcctcctgtaccggttctctgagaacaggttcttccggttttctttccttttccttgggagtttgtctttccatccggggcagctccggtactgccctgggcacagggatttctttgaccggaaagttggcggcgcttaatatttctccggttccctgccatcttcccaccacttccctcccggcaaaaaggcgaatacaaatcccgcatatttcattgtattttcttccgccccggctgactccgtccggcgtaaactgcctggtataagaacctgtcccccttttcagaagaattttgtcaataatcgctcctgtttcgtcccgtaagtcaaagaaacctgtgtctgtctcatacaggccctttatctgcatattccaggttatggtatcttctgtttcttcccgcttcagaaatcctgcattttttattttatttccggcttccatatggtctaagtaaataatctgcctgttataatacaacaccttgtccctcctttatagtctctattgtattcggaaggattcatatatatgactaaatttaaaaaccggaaaacagcatgtcctgttttccggttccttcattttctttagcctgactctgtactcacaaattaataatcaatgctttccagatatttcatataattaactaccatcagcgcaatcttaaaggtaagcgcatcatcaaatacacggatatcaagtccggtactcttctgcagcttctcaatacgatataccagcgtgtttctgtgaataaacagctgtctggaggtttctgatacattcaggttattctcaaagaatttattgattgtggtcagagtttcctcgtccatgtcataaggtacattatctccgaagatctcttcaataaagattttgcagaggttaacaggcaactgataaatcagacggccgatacccagcttcgcataggagatcacacatttctcggcatagaaaatcttgcctacatccatagccattgtagcttccttataagatttggaaacctctctcagttcgcttacaaccgtaccataagccacgcgtacattcatcatggcttcgctgttcatcatgtcaacaatcatgtcagctgttttctcgatagtatccagatcatcttctctttccagagctttgatcagaatgatattcttctcatcaacggcagtgatataatcaccattctggctggagaaaagactcttaagcatttccatggcgctgttgtctttttcaatcttagtctcaattaaatagataatcctggggcattccacttcgatatgaagcttctgtgcgcggttgtaaatatccacgagaagcaggttgtccaataacagattctgaaagaagttattgcgatcaaagcgttctttgtatgccactataagattctgaatagagcttactgcgatcttacctaccatgtagacatcatcactgggaccctgggctacaagaatatatgccggttccccatcatcaagaattttgagaaggtggcgtcctcccactacctgactgtctgctggtgaagaagcgaaattttcaattatgtccctggaaatatcaatctcgtctactgttgtcgcaactttcaggccttccacgtcaaataccccaaggtcaacctttgtaattgcacgtaattcgtcaatactgttttgtattacttgattggaaatcatctctcttcacgtcctttccttgttacaattaactatatagcaaaatctccaaatatgcaagaaaaaagggaagatgcatcgcatctcccctcccatttttttattagttggtgataacctgctctgtttctttgtcgaaaatatgaatcttttcaacgtcgaatgcaaatttaacagtatcgccaggtcttgctgttgtacgggaatctactcttgctgtaatcgggtaatctgcaagatcaaaatacagataaacttcagcaccaagcaattcataaaccttgatggtagattcaaatgtacatttagctgtttcaataaacatctgggaatcatatacgtcttcaggacgaataccaaatgtaactgtctttccggcataaccgccttcgataaccttcttagcctttgcaggaggcagaggaatagcttttccggctactttcagggaagcattgtcgccgcttacttcaacaacagcatccaggaagttcatctgaggtgatcccatgaatccggcaacaaacaagttctgcggcttgtcatacaggttctgaggtgtatcaacctgctgaataacaccgtctttcataactacgattctggtacccagtgtcatagcttctgtctggtcatgtgtaacatagatgatggtggtacctaatctctgatgcagttttgcaatctcaatacgcatctgaacacgcagttttgcatccaggttggaaagaggttcgtccatcaggaataccttaggattacgtacgattgcacgtcccatagcaacacgctgtctctgaccaccggacagagccttcggtttacgatcaaggagaggagtaaggtcaaggatcttagcagcctctttaaccatcttatcaatttcatccttcggaacttttcttaacttaagaccgaaagccatgttgtcatatactgacatatgaggatacagagcgtagttctggaataccatcgcgatatctctgtccttaggctctacgtcgttaactactctgtcaccgattttcaattcaccggaagagatatcttccagaccagcgatcatacgaagtgtagtagatttaccacatccggacggacctacgaagatgatgaattctttatcagcgatttccagattaaagtcttttactgcttcaaatccgttgggatatactttgcagatgttctttaaagataaacttgccatttagttagcctccctatttttgttttcatgtttccagttgcgttctctcaactgagcctgaattaagtataacttaagtgctaccttttggctataccacaattccacaaatatttatcgcgacattgtaaaatttgctaagaaaaggagaacgaaaatttagggcctgtcaacttgctcaaatcagctttctattattatacactttgaccatatccccgatactgcgcggttttcgacacttcaaactccttttccaagagcatttatttcacttttacgtatatttcatttccataaaatgacatcaaatcagctttgcagcttaacggtatagagtgtacattccgtctcttcctgccgtttttaaaagttcctgccgctgttaatacagaccgcctattcctggttttcttcttcgcttttctcttccggcgcagcttcctgaacagcctgggcgccttcttcttcctgcgcttcttctttgagagctctctgcttctgttcctgttcctcacggataaaggaaagagtctccaactcatccgactgctcttcctcttcctcaggctcaaaacgcttgaaaatcttcacaaaaagcatgctggccacataagccggtacggaaaagccaaacaggattacaatgggcattgcctgaagggttaccagcaggacaaccgcaggaaccagattgatgattaccagcagaatggttttgggcaggttgagaatgctcataagaaaagaatttcttatggtattcttcactgtgttttcaaatctggataatacggggaaaatataaatcatggtaaaaatataaataacggcaactaccgtaatcaaaaccatgatcacctttccgaaggaaagagttgaatttcggagaatcaaaaaatcaccaaccaggatgattcccaccagcagcgctatcagccagattatggtagcctgcttgaagttctccttaaaggatttaaaatagcccttcactatgtagcactcttcatttttgaccatcttgacggtcatgtaataaagagcggtcatcgcatcccctgccgtaatgatcgggatacagcagatcagcgttaaaagattcagaatcattaggtctgccatctttgataaaaaagtcataagagggctgtccaagttaaaaaatctacccatttgtatatctccctgtgcttattctataatacgggcgccactgcctgcccgccggcgtttatagtaaatatcatactacgggataggtttcagtgcaaataaaataattattaataatacaaactccgcccctgcccccggtaccgtgcctgccgtcccatccgtcatctctcccttccttcggcggcggttaagcagggatccttagagggaagacgacttttagtcgtttgctctcgctcggataaacacgcagcggtactaaggccgcaaagaacgcggccttagtaccggcgtgtttatacgccccttacaggaaaccctgcttaaccgccgccgagggaaggacgggaagacggatgggacggcaggcacggtaccggggcaggggcggagtttgtattattaatctttcttattccgccttattctttaaaggccgcccgttttccagagcataggcattttccagtgtttcatgggcaatggcctgcatggcttctaccgtaaagaatcccatatgggaagtaataagcacattgggaaatgttgtcaggcgcgccagattatcatcctgaatgatttcatcggagcagtcctcatagaacaggccttcctcttcctcatagacatcaagccccacaccgccgaatttttttgccagaagaccatcgattaatgcctgggtatcgatcagaccgcctctggaggtattgaccagatacacgccgtccttcattttggcaatagtatcttcatttataatatggttggtttccggtgtgagaggacaatgcagggaaataaaatccgatttggaaagcagctcctccagccccacatactgaacatccagactcttgttgggataaggatcatatgcaaggatattcatacggaagccctggaaaatgcggatcatggcctgtccgattttaccggttcctattacgccggccactttatggaaaagatccgtacccatcagtccgttgatattcatgttgaattcccgggttcttccatacgccttatgcgtaaaccggtttaccgtgagcagcatggccatggcgaattccgccactgcttcaggagagtagctgggcacccgcagaacttcgatttttccctttgccgccttcacatccacatggttatagcccgcgcttcgcagcagcagcgcctttaccttattttcatatagataatctatcattttgccgttcacatgatcgttgacaaaaatacaggccgcatcataaccctttgccaggaacatagtttcttcactgaagggcagttcgataaaatagatttcatagccataatcctttgccataggttcaaaccagatacgatcatagggctttgtactaaaaaaagcaatccgcataaaaaggccttcctttcccctggataaaaaataatattttcatccggtgtacagtgtacacaaatagtgtacacagaaggccgttttttatacttatgcttttgttcttaaactttgccgcacgataaatgtaatcggcggctgacagttctcatcaagaaaacaggcgggcaaaaaaactgcgtatgctttctcccatatcccggaaaaaatcacggatggcggatttagtcccctccaccacggcttccttcacaggctccacaatattttcctgtatggcggcatccgcgcttttctttatctgttcgccatattcctcatacagctcctgcgccttggaaagcatttcgtcggaattaagccccagggcattcatcttctgaatcagccccagaagctgttccttctgctcctccgtaagggtgatctccagttcctcctcacattgggaaattgcctcccggatctgctcatctgtctccagttcccccgcatccagcttttccttcatcttttccagaagctttttttgttcctccgttagagtcagagcgctccctgcgctgagagggatctcccgccaggattcctcctgcccctgtgccggcatggcttccctggcagacaaagctaaggccggaaatcccgccagcaatccggccgtcagaaaagccgtcagcattttacatgtacattttttcagtctgctgcattttctcaattctctgcttcctttttacctgcggttttaaccgcccattcataaatatccttccagaccagttccctgtcgctttcattgacaagctcatgcctgtcattttcatacagcttcaggcttacatcctccattcccagatcacggaaggactggtacacgccttccacagctttaccatagtcccccaccggatcctcggttcctgccatgaacaggacaggcagatcctttgtcattttttccagcctgctcttatcatgcagccggtctataagttcaaacagtgtggcgaagccgccaagggtaaaggtaaagccgcaaagaggatcttcattatatctggccacttccaccgaatctctggacagccagtccatggaagaaacgggatgcggaattcttttattatagctgccgaaggcaagggcattcaccagagcgcttttatgcttttctccctggaaaacagtgaggaacttcaccagctttttggaaaatcccagcaggcctttgggctgcataccggttcccatgatgatggcgccgtcaatttcccctccgtacacacacaggtaattgcgcagtatgaaggaacccatgctatgccccataatcagatatgggattcccgggttttcctcccggattctttttttcaggctctgcacatcctccacagccgccgtcgccggatcctgatggcagaaatatccgtacggatggctgctgcccgcgccgtttccggcttcttccatattcttatatatgcttttgccatgccccagatgatcattaccggttacaagaattcctttttccgcaagaaagaccgccagccggtcataccggttgatatactccgccatgccatgtacaatctgcaggatgcacaccggcttcccctcaggtatccattctataccatggattttggtcactccgtctgcggaatcataataaaattcctttttcttcatttgtaaccctccaaagcattttaccaaatgcttttcctatccgctcacaccgcgggcaaacacccgcgatgcagtcaacgtgtcagcagatctccgcgcctgccggcatttccttttccggaactaccagggcaaggtttccgtccgcatcctccgcacacagaagcattccttccgatacgataccagccagcttggcaggctttaggttcacaagcaccataaccttcttgcccaccatctcttccgcactgtaatgagccttgatgcctgatacgatctgttttacctggcttcccacacggacctgggaacagagcagttttttggatttcttcacttcctcgcaggcaataatttcccctacctggaactgcagcttctcaaaatcctcataagtgatttccggcttctgatcaatatctatcacatcggaagcagcttcctgcgcctcttcacccgcgccttctgtttccgcctttctggctgcaaacattgcctcagccttttccaccacctcttttgcatccagccttgcaaacaggatttccggtttatcggtcaccttatttttgcagggataatgtccgaataccgcacattcttcgaaagaaggcagggctgtattcagctgggccgcaattttagcggaggtttcgggcatatagggctctaacagagaggcgcctatggtaatgctctccaccaggttatagagaactgtggcaaggcgatccttctttgcctcatcctttgccagaacccagggctctgtctcatcaatatatttgttgcagcgcttgaacagggagaaaatctccgtcatggcatccgcaaccctcagatcctccatcttgtcacaaaccctggcataagttcctgtgacaacagccttcagatccgcatccacatcttccgcagcgcccttgtcatccacaacgccgtcaaaatatttattgctcatggaaatggtacggtttaccagatttcccagggtgttggcgagatcggaattgattctttccaccatcagttcccagctgataacgccgtcattttcgaagggcatttcatgcaggacgaaataacggaccgcatccacaccgaaaaattccaccagatcatcggcatacattacatttcccttggatttgctcatcttgccgtcgccctgaagaagccagggatgaccgaatatctgcttcggcagcggctcgcccagagccatcaggaaaatgggccagtaaatggtatggaaacggatgatatcctttccaattaaatgcagatcggcaggccacagcttcttatactgatcactgctgttcccgtccgcatcataaccgattccggtgatatagttggtcagggcatccagccatacataaaccacatgcctgtcatcgaaatctacaggaattccccatttaaaggaggttctggacacacacagatcctgaagccccggaaggaggaaattgttcatcatttcgtttttgcgggatacgggctgtataaattccggatgctcattaatatgcttaataagcttatccgcatacttgctcattttaaagaaataggcttcttcctgggcgggctttacttccctgccgcagtccggacatttgccgtccaccagctgggactccgtccagaaggattcacagggagtacagtaaagtccttcataatgtcccttgtaaatatctccctgatcatacagacgcttaaaaatcttctgtacctgttttacatgataatcatccgtggtacggataaatttatcataggatgttcccatcagatcccagaggccctttacctcaccggctaccttgtccacatattcctgaggagttacccctgcctcctgggcttttaattcaatcttctgtccatgctcgtccgttccagtctgaaagaaaacctcataaccgtcctttcttttaaaccgtgcgatactgtccgccagaaccgcctcatacgtattcccgatatggggtttgcctgaagtataggcaatggcggtagtaatataatactttcctttgctcattttttagtgctcctttcctgatttttccttatcgcttccgtcaacaaaagctcgtcttcttattcttaagcttttgttaaaaataagaagacgagccttacgcccgtggtaccacttctttttaccccattctcacaaacagggccttagcaggtacatcagaaacagtttcctgcatctttcataccctgccgctgtaacaggcggcacctgtcgcagccttgcccccggtgtcccggcggttcggtgcgctgctccgaagccatcttccatccttttcggcccgatccctctcagccttcggcagcggcacatggccttccgcctgcgggatcttctctgtaaagcttccacgaatgtactttcttcatccttgcttttttgtattaactggccggtctgccggccgattaccttcagattatcacaatccccccacgttgtcaaaccttgcggtacctgtccgcgtattccctgtgcttatccggttctgagaatttgtctgcgggcattgctggcttcggcctctccgtacaggctgcgggacagcaaggttcctgtgcgggcacgctctcgctcggataaatacgcagcggtactaaggctgcagaggacgcagcctaaggaccggcgtatttatacggcccttacaggaatccttgctgtcccgcagcctgtacggagaggccgaagccagcaatgcccgcagacaaattctcagaatcggactccacagggaatacgcggacaggtacctaatgtatcaattaaatcaccagttgttaacggcgtgttcggcgaaggatataatgttgtttatttccaaggtggttccgtcgtctaggatggctttgccggtgaaggtgccgaacatttggtgacagcagttgtttacccagaggagtttgatgcgggtggttctgtcgtacattggggtgagggtgaggtcgaggcggccttctttgtcggtcaggtgccagggatcgagatattctttgccgagggtgaaatctactttgcccagtttgtgggactttcctttgtaaaaaagtatattttcgcttgctgtgtctgtgtttccgaagccgcagccgagattgaagccaaagatttctccgttcaagcagccggtgccgttgctccagtaccattcgttgtggaagggccagacgcctcttccccagtccaggattccgaaggagctgtctttttcgaaacgccattctttgtctgcgttttttacaaagccttctgccgtcatgcagttgattttgtggttgtaataaaaggcgtgggcgtattcgttaaagggaagattaattacgagggaatccggattttttcgttccaggcggatgctggcttccagatcgccccatctgcaggtgagcactcttccatccttccgggtctcaaaacgcataaatatgccgcctttatcgtaggtcagggtattgtcctcttccgcgttttccggcatgtgcagggagccgaagggcagaaccaggattttgttcagatccagcagtttttccccttttacaaagtcaaagagcatcaggcttacctggcccgcataagcggcatggccgatggtaaactgaaggcacagcctgtcattggaaatctggtaaaaatcccattctttgattctccatggcggagccttgattgctttcctgtcatataccagcgtgcttcttctggaataccccggtatggggcggcctttttcatccagcacaggccctctttccagcagttctttttccatatccatcccccttttcttactgatttccccgacaaaccgcagactatatcctgcctggcacagctatcaccttatctgtccctgcagcctctgccggttcatttttccggctgcggcaagaggtatcagcgtaaataatgtgagcaccgcagaaaccaggaaaagactgggccccggcaccattcccaccgtgccgctgacttccatttccacgcccatccggttaattacctgcgtggctatggcaggcccgataatcatgggcacacaaacgaagaaaatctgtttgattccctcaaactgtccccgctgctcctccggatacaaatttttcatccaggccgtaagcgcctgcagtacaagaatatatccgatccctgccccgaacactccaataagcaaaaccacaaggctttgggaaatactgaccataaccagccccgccatattacagataagagccgtcaaaataacctgcggtgttttgcccttgtcaataaaccgcgccgccggaatcgtcatcaccgcagccgccaaaagccccacaccctgaatgattcccgtcatcccatagccatatcccagataattcacgaaatagatggtaatatagggaaagtaaacattaaaaccgataaaatatacggtcatcaccaaaaacacccagaacagctctttattctcccttaccgtattccagttaaacaccgtaaggaactgatgccaaaagcccttctcatcctttttcggacgaagccccggcgcatcctccaacgtaaagaacccgaaaatccccaccagagccaccagccctcccatcaggccgaaaaaagcgaagaaatcaatctgctcaataataattcccgaaaccaccgccccgaaaatagtggcaaacaccggcatcaccgccagcgctccccccagcttccccctgttatgctcattagaaatatccgttgtccaaggcccgaagcccccatcattccccacagatccaaaaaagctcatcaccgcatccgccaaaaccacacacgccgccgcaataaacaatggattcttaggaatcatctccgtcgccccaaaaataaaagtaaaaatcccccacaaaatataccctacacaaataaaaggctttctcctccccctcctgtccccccaggtccccaccaaaaaagtacaaaaagtcgaaacagccgcactcacccccaccatccaagacacaatagccggttccggcgcgatcttgtcataaacaaaagtattaaaccaagaattctcaatattccagcaaatctgccctgtcatcccaagcacccaaatcaaaacccaattcttccgactaatcctatccataattctcccctcattgattatgaaaaaatatacttcctataccccatcttacactctttaccacatgttttccacaacaatcaaacattttcatccccctatccacaatccctgttataatctacctacgcactgtgcatcgtgtcttccgccgggcggcttgcctctctggtttccccctgcggcgctccttcccggggaatctgtataccctgcaaaggccttctaaaaacgccggtccttagattgcgtcctttgcaatcttagtaccgctgcgtttttagcagagtgaaaacgtgcctgcgcagggtatacagactccccgggaaggagcgccgcagggggaaaccagagaggcaagccgcccggcggaagacacgatgcacagttcaacccttcattgtattttacccggataagtgctaaaatacatgcatacaaacacaaaatgccgggcaacggcagaatggaggatttatgagcagaaaagtagtactggccggcggctgcagaaccgcaatcggcgtaatgggcggagcgctttccaccgtacccgcggcagatcttgggacaatcgtaataaaagaggctatgaacagagccggaatcactccggatatggttgacgaagtatatatgggctgtgttatccaggccggacaggggcagaatgtggcaaggcaggccgccgtgaatgcaggcatccctgtagaggttcccgccaccaccatcaatgtgttatgcggttccggccttcactgcgttaatctggccgccaagctgattgccagcggcgatgcggacattatcattgcaggcggtacggaaaatatgtcccgtgcaccgtatttggttcagcagggccgtttcggctatcgtatgggcaacgcgcctcttgaggattctttactgaaggatgccctcaccgatgccttccacggctaccacatgggcatgaccgcagaaaacatctgtgagcagtggggcctgaccagagaacagctggacgaatttgccgcaaacagccagcagaaatgtgaagccgccatgaatgaaggacgtttcaaagaggaaatcgttcctgtggaggtaaaaaccaaaaagggatccgtcatcgtggatacggatgaaggccccagaaaaggcgtcaccgccgaaggcctcgccaaattgaaaccggcctttaaaaaagacggcggaatggtaaccgcaggcaatgcttccggaattaatgacggcgctgcagccatcatagtcatgagtgaagaaaaagcgaaggaacttggcatcactcccatggcaacctggattgccggagaactggcgggcgtggatccttctattatgggaatcgggcctgtggccgccaccaaaaaggtcctgaataaaaccggcatgcagatcggagattttgatctgattgaggcgaatgaagcctttgccgcccagtctgtagctgttggacatgacctgggctttgaccttgacaagctgaatgtaaacggcggcgctatcgccttgggacatcctgtgggctgctccggctgccgtatccttgtaaccctgctttatgaaatgcagaaacgcgatgtaaaaaccggtcttgccaccctgtgcgtgggcggcggcatgggctgcgcggcagttgtaaaacgggattaatacacggagaatgcattctatcattattccccgcggcctcagggtctgcggggaattttatccatagggacagatgctgtcatggtaaggaggtgtgctcttatgagacacgaacgaagtaaaaactcagtacagtttatgtaatctgccggcagattgtactgaggttatgttttccgctgacagacatagctgtactgacttttatgctgcttttcaaccatgcacataaggagtacagatatgaattatttaaaagaaattgccggaaagaataagatctggatttgtatttacataagtcttggaatcggcttatcctttttgtccaattacaatatcagtttctttcagaagctgattgataaatttactgacggcacgctttctttaccggttattctggtctatggcggccttcttttgctgctgtgtctgggaaattacctggatgaatatccgatgcagaagctcaataacggcatatatctggatttaaagcttctcgccctgtataaaacaagccggattgattatctggcttatcaatctatggggacgggaaagctgatacaaagagtagagaacggagccatggcgggaaaaaatatactgtgccagttctggtttcgaattgcacgggaactgcttccttccgctttgttcagcctgttttttatttaccgcctgaaccatgtgatcgcctgtacagtagcctgcggttatcttctggtttttcttattaccaatttattgctgaagcttctgtaccggatgaaagaaagagttctggataacgaagaactgcttaaccactttctcacgcggggcttcatggaaatggtcgttttccgcctgaaccggaagtttggcgcggaaataaagaaggcagaaaaggccagagatcagattgtacgctccaaaatagggatttcctttatccacgaagctttttttgcagcttttgcaatccttattactttgatcaaagcggcgctgattatatacgcctggtatacccgttccatttccatcggttcggttgtcgccctgctcactctggtggataatgcctacacgcccattgctatttttaatgtattatttgtgcagttccgtctggatttgtctgcattcggccgttatgctgattttcttgatttaccggaagaatcccggctgtttgaagggaagaagcttccggaattccatggggacataagcatccggaaggctgttttttcctaccatgacatgcctgtccttaaagaggtgtcactgtccatatctcccggagagaaggtggccctggccggaaacagcggttcaggaaagtccactctgattaagctgattgccgggcttctgaaaacggaagaaggctccatcttaatagacgggaatgatctgaaccggcttaacctggacagctattacaggcatattacatatattccccaggaaagcccggtatttgacggcaccctccgggaaaaccttttattcgatgcattgcttccggacgaagacgcaatccgcgttttaaacaaagtacagctgaagggttggtttgacaacctgccggacggactggacacgcagttaggggagaaaggcattaagctgtcaggcggcgaaaggcagcggctggctcttgcaagactatggttttcctcctcccggctcattattctggatgaggcaacctccgcgatggataatgtaacagaggagctggttatgaatgaagtgctgtcactgacgaacggcagaaatatcattgccattgcccaccgtttaaattctatccgttcctttgacaggattatactcctgaaaaatgggaggctggaaggcgatggaagcttttcagatcttatgacatataatccgtattttcaggaactttaccgggctggtatgtagattctgaccgtaaatattcactgaatgcacaaatcgccgccaggccttacaacccggcggcgataccatttgtgaaattggattttctttcattttctgcaattacttacagtaaccggtctccaaatcaatcacatttttaagcggttcgcctgcctgataccgtctcaggttatctgcaaaaatctccgcaatctgctgaagggtttccggcagcgcatatcctcctgaaatatggggtgttataatcgctccgggcgctttccagatgggatgctctgcaggaaggggttccggatccgtaacatccagggctgcacctgcgattttaccctcatacagggcatcgctgagagcatccgtatcaatagcggtgcctcttccggcattcagaacaatggcattgggagaaagcaatgcaatgcgctccctgttcaggacatgataagtggacgggttgccgggaaggctcatggcgaccacatccgcccggggaagaaggttatccagttcttccattccatagagttcatccacatcctccggtttgtctcccacgcggcgctttactcctatggtatggcagcccagagccttcatcttcgctgcgaaagaggttcctatatctcccaggccgattacaaggaccgttgaaccctgtatgactccaacatggccttcacttttccaccggcatgccagctggttgacataatataagtccagttttttgcggagcatgaacagacaggccatcatatgctcagatatagccaggccataggcgccggtagcattggtgagcagtgcgtccccgggcagtattcccggtgtgcagtagccttcggttcccgcattgttcagctggatccacttcagattttctgaggcctgcagctgttccggtgattccagattgcccagaatcacctccgcttctttcaaaatgtcaggcgtaatgtcttttttcagacagaacctgagatctcccgcattgactgcggcagaacatatcttccttttttgttcctccgtaaaaggaggcgttaccagaattttcatatacccttccttactgccaatactttctgacggcttcctgtgcttcttcttcgctgatgccaaacctgattttcaccttttccactgtttgccggaaatcaacacctaattccttacaggtttctgttaaagctttcattccctgctccaatccctgttcaagtcctctttcaatacccttctcaattccatcatccaccaaaagcttccccaattttgtcatagctatcatctccttcacctgattcagttctttctcacttacaaacttatccgcaaaagtatataacactgccagcattttttcctgttcttccgccgacagggctcccttagcgtcccgaagaattttcatgcctttaataatgcgttccccgattggggattcgccggacattaacggggttaagagtacagatacgaaatcggcccgttccagcctttctccacgtcttctcttttcttccagccgtctgaacagcaaatcagcattccgtcccttcagccggacaatctttaccctgtaagtattaatacctaccttcagttgcgccttcaggcacttcacttttgaagaacaaatgacgtaagtaaccacctccacgccgaatttccggctcactgcggcttcatattcccgaaacctccttaaatcttcatctgtaacagaatcactttcaaattccagatgtgaccagctcctgtcctccataacatagttaaagtcctgatacatctgccttgcctcaagcttcactgtctcggtcggcgctatgtattccactattcccgagatacccagtgcaggaagtaattcttcaccaaaatagtgggcagcggtctttaaggccagatcctcatgatggagtccctggttttccgatggtttttcctcatcttttcttatgtcttccttcacacagcctcctgttccgtaagccatgcgtaaaaacctgtctcctatttaattataaccactcatacggccccggacaacatactcttacaatttttatttttgctttcttatcataccaaggaaaatcttgtccgatatggacagaatgaattgttttatttcagaaatgtttgttgcactccagacagattttacacatatcaatgctgtcggaaccgaatattattataccataagctgtaatttcctccaacctttttgtgaatcttatgaatcagtactccatttttctgaagcacccggaaacaaaaagaatggccgcagccattcttttcgatttattttccatccgggccgggagccaggatttccatcatatttttcacgttttctgctatatttccgttgaaaattgcggatcccgccacaatgatattggcaccggcatcaagaacgacctgcacattgtccctggtgataccgccgtctacttcgatatccacatgagcctgccgggcatcaataagctgccgggcctcccggattctggccgtggaggcagggatatacttttgtccgccgaaaccgggttccaccgtcatgacgagaagcaggtcgattttgtccagatatttttccacagccaaaatgggggtggagggcttaatggaaatccctgccttgcgtcccaggctgtgtatccagtccagcgtttcttccacatcgctgcaggcctccagatggacggtgatgatatccgcgccgcttttggcaaaatccgccgcataacgtatgggctcttcgaccataaggtgtacgtcaaataccatatccgtcacttttctcaaagaggaaaccacacacatgccaaaagaaagggaaggcacaaacatgccgtccatgacatcaatatgcagatattcggctcccgcggcttcaaccaggctgatttcttctcccagcctggcgcagtccgccgccagaatggatggtgataaaatattcatattttttctttccttttgcgctgtatggccggccccaaaggagccggcatgcctttttcaggtttattttacaaacgcttttacttttccataaattccttctgcatccaggccatatttggcaaccagggctcctgcggatccggattcaccaaagatgtcgttcattccgatacggcataccggtgtgggcgctttttcggaaagcacttcacacacagcgccgccaaggccgccgatgatggaatgttcttccgccgttaccacttttccggtcttctttgcagatttaatgatgagttcttcatccagaggcttgatggtatggatattgattacctctgcgctgatgccgtcggcagcaagcttttcagccgcttccagagcttcgggcacgcaaatgccggtggctacgatggtaacatcggttccttcgcggagaagaacgccttttccgatttcaaatttataattatcattgtcattgattaccggtacggcggcacggccgaaacgaaggtaaacaggacctacatattcaagggctgcctgaactgcggctctcgcttccacggcatcacagggattgattactaccattccggggatgacacgcataagggctatgtcttccaggcactggtgggatgccccgtcctcgcctacggtaattccggcatgggtagcgccgatttttacattcaggtggggatagccgatggaattacgtacctgctcataagcacgtcctgccgcgaacatggcgaaggagctggcaaaggggattttccctacggtggaaagtcctgccgcaatgcccatcatgtcacattctgcaataccgcagtcgatatggcgttcagggaatgctttctggaaggtattggttttggtggcatttgccaggtcggcatccaggactaccaggttgggatactgtgcgccgaattcagcaagggcttttccgtaagcttctctggttgcgattttctgaacaggtttgttatttacttctgacataatgcttcacctactttctccaaatctgccattgccactgcatactgctcatcattaggagcggttccgtgccatgccacattgccttccatgaaggaaactccttttcctttcaggctgtgtgcaatgattgcagtgggcatgcctttggtttctttcgcttctttgaatgccgcgcggatggcatcgaaatcatgggcatctatattgattacatggaaattgaatgcttcgaatttcttgtcgatagggtacggagagcatacctggtcgatggggccgtcgatctgaaggccgttgttgtcaacaactactaccaggttgtccagcttatggaagcctgcgaacatggctgcttcccatacctgtccttcttcgatttcaccgtcgcccagaagggtatatacgcggtaatctctgttatccagttttccgccgagagccatgcctgctgctgcggaaattccctggcctaaggatccggttgacatgtcaacgccggggatgtgctgcatgcagggatgtccctgaagataggaacccagtttacgcagggtggtgagatcttctacggggaaaaagcctctgtgtgcaagggtggagtaaagtccgggggctgtgtggcctttggacaggacaaaacggtctctttccggtttgtcggggttctccgggtcgatgttcatttcttcaaagtagagataggtaaagatatctgctgcggaaagggatccgccgggatgaccggctttggcactgtgaacggctgttacaatgcctttgcggatctcgttcgccatttttgcgagttcaagattatccatgaatgattttcctccatataatatgatttggggtggggtggtggtgaccaaataaaaggacacgatagagcggaagggggtgaggggggccggggtacggggtggtggtaccggacggcagaacctcaagaccttcggtctttcggtcgcttcgctcgccgggcaggttcagaaggtctgggaagggcaagcatggatgtggggcgtatccatgtttgtccttcccaggccttctgagcctgtccggttctgcctggtcacgaatataatactctatttacccccgttttgtccatagtaagcgttggctccgtgttttctgaagtagtgtttgtcctggagttcctggggggcgggctggattcttgcgttgattgcttcggcacggtaggccattttggccacttcttccagaactacggcattgtgcactgcttcgtgtgcgtctttgccccaggagaagggtccgtggtttttgcagagtacggcgggtactgctttggggtcttttcccatggccttgaattcatttacgataagatgtcccgtattttcctcataggcgtcttcgatttcttctttggtcaggcagcgcaggcagggaacctctccgtaaatgtagtcggcatgggtggttccgtagcagggaatgcttcttccggcctgggcccagctggtggcataggaggaatgtgtatggacgattccgccgatttcaggaaatgctttgtacagctccacatgtgttgccgtatcggaagaggggttatactttccttccaccttatttccgttcagatccacaatgaccatatcttcaggggtcagcttgtcataatccacgccgctgggcttaatggcaaacagtccgctttctctgtcgatttcacttacgtttccccatgtaaaggtaaccaggccgtgccggggaagaagcatattggcctcatatactctttttttcagttcttctaacatgtttccatcctcccgtccgctttggcggacattttttaccaaaagtcttctgtttcctgatatgggcgccctccgtcagaaaggcgccgcatgatttacagctaaatcagattttccacagccgccttctcaataggaagccctttcgtataacgttccacaaacttattgaagccttccacatctcttgggtcgggatcgatcttcacgccggcatttcctgcaaacactctgttatccaggaactgtgccagagattcgccgtcctttttggtcatcatataagacgccaggagggcaattccccaggctccgccttctcctgcggtttccattacggataccggagcgttaacggctgccgccaaaagcttctgtcccacttcctttgtcttgaacaggcctccgtgtcccagcagcttgtcaatctgtacattctcttccttcagaaggatatccaggccggttttcagtgcgcccagcgcggtaaacagatgaacacgcatgaagttcgccagattaaaattactttccggatttctcacgaacagcggacgtccctcttcaaagcctgtaatatgctctccggagaaataattgtatgccagcaggcctccgcagtccggatccccttccaaagctttccggtaaagggtgccgaacagatcatttttatccaccttcataccgaacgcctgtgtaaattcctcaaacaaatcaatccatgcattcagatctgaggtacagttattgcagtgaaccatggcaacggcgcttccgtcaggggtcattaccatgtcaatttcaggatgtacctttgccagttctttttccagtactaccatggcaaatacactggttcccgcagatacattgccggtacgctttgccacgctgttggtcgccaccattccggttcctgcatccccttccggaggacaaacagggattccggcctgaagctggcctgttgtatccagaagacgcgcgccttcttccgtcaggcagcctgcattctcacctgcaacaaggatttccggcagaatatccagaagcttccaggaaaagccttccggagccacaagctcatcaaaagcctttaccatcctgctgctgtactgtctggttgccgcatccaccggcatcattcctgccgcctcgccgattcccagcaccttcctgcctgtcagcttccagtgtacataaccctccagggtggtcaggaaatcgatatccttcacatgctcttctttattcaggatcgcctgatacagatgggccacgctccatctctggggaatattaaagtcaaaaagcttcgtaagctttacggatgcttcttcggtaatggtattcctccaggtacggaaaggcaccatcagctctccctctttattgaaagccatatagccatgcatcatggcgctgataccaagcgctcccaccttcgtcagagtcacgccgtatttggcctgcacatcctttgccatttcctgatagctgtcctgcaggccgttccagatatcctccaggctgtaggtccagatattattttcataacggttttcccattcatggtttcccgccgcaataggagcattatcttctcctaccagcacagccttgattctggtggatccgaattcaatacctaaagcagtcttcccgtttacaatcgcatctctaatttctgtcatacccattttaaaatcctcctccttatctgtaataaatactgttccatctcagctcattcttgaaattgcggatggtggtgtctttatcaataacaacgctttcaattcccatggccgccgcccagtcaaccatctgatcaaccgttaaatcataagaaaatgcggtgtggtgagctcctccggcaagaatccaggcctgtgccccggtcgcaaggtcgggctgaggagtccagaaggctgtggctacaggaagcttaggcatttctttttcacacttcttacagtcaaccgcattgataatgaggcggaaacgattgcccagatccacaagggaggtggctaccgcgggacccgttttggaagtgaataccaaacgagcgggatcttccctgttgcccatggaaagcggctgtaccttaatggatatggggccttccgcaatcgaaggacaaacttcaagcatatgcgcctgcagaattccttcttttcccggaaccagattgtatgtatagtcttccataaaagaagttccttttgctcccggaactcctgccgccataattttcatcaggcgtaccatggccgctgttttccagtcgccttctccgccgaaaccatagcctttttccatcagcctctggatagccagtccgggaagctgctgcagcccgcccagcatgccgaaatgggtaacaatcgcatgataatccccgtcttccaggaatttctcaaggccgatctctattttagcctgagccgccacatgagcgcggaattcttccggatccctgccttccagcagaatctgatacttgctgtaatactcctccacaagggcgttaacgtctccctcggaaacagcatttacgtattccactgcgtcgtttacacagtagtggtcgatttcccatccgaattttacttcggcttccaccttatcaccttcggttacggcaacattattcatgttgtctccgatacggcagaccctgatgtgggaggattccataataccgatagccgttctcatccagctgccgattttttcctgtacttctgcattcgcccaatgtcccacaataatcttgcgttccatccccatacggcttaccatatggccgaattccctgtctccgtgtgcggactgattttcattcatgaaatccatatcgatggtatcgtaaggaatttcctcattgaactgggtgtgcagatggcacagcggcttgcggtattccttcagtcccagaatccacatctttgcgggggaaaaggtatgcatccaggtaatgacacctgcgcattcgccgtcctcattcgcctcattgagagttcttctgatggtggccggatcgatcaaagtgggcttaagaaccacttcgaagggaagcctaccggacgcgttcagcccttccacgattttggcggaatgctctgccacttttctcagacattcctctccatacaaatcctgggaacctgtacagaaccagaatttgtagtctcttcctgttttcatttcacatttcctcctaaataaaatttatttgtaattgttcctgtttaccctgaaattaactctcgccttgttatacccgattcaggctcctgacggaatctctttccacaatttccgtcacaaattcataattcccgtcaaaatttctatttttcatgatggccagcagattttccgccgccctggcccccagcttatccgtgggatgatgtacgctcgtcagcctggtttccgccagctccgccagctccgaatcgtcaatgctgatcagggaaatatcctccggcacccggattccctcttctttcagaaggacctccagctgaaaggcgattttatcgttatagcagaaaacagcggtgcattctttaaaattcctcagaatcctttcccgataatcatggaggtgctgctctccctccgtatccagccagacaatcccggaatctcccgccggaatccccgccttcctgcaggtatccagataccctgcataacgcagatgcccctgtccgtcatcgaatttcaaaagcgctccgactttacggtgccccgcatggatcagatattccaccgccatttccgccgcccgcctgtcgcttaaggtcacatgaggcagaggcagtccgggataaaagctgtttatgaataaaatcgggatttttcgttccatcagcttctgcaacagcggcaggttcggattgggcagaccgcttttcgtggcttccataataattcccgccacatcgtccctggctgtgatgtcttccagtatggtacgctcccgttccagctgattattggtaaaagcgatttgaaccgagtagccccgttcaaacagggtattttctatcccctgaatagtcctgggaaaaatatagctgtccacatacgtggttaccaccgccactctcgtcttattctcaaggttggccatccggttgtcactgatataggttccgcttccctgccgtctggcaacaatcccttcctcttccagaacgccgatggcatgccgcacggtctgtctgcttaagccgaacagctcactcagctcgttctcagaattcagcttatcaccgggactcagttccttcttttccagcctttcctttacccagtccaccacttctttgtacttgggttttctctccatccgcagtctcccctcccttccagttgtatttattctttctcaagttgtattctttttattaccccggctgttcacatggtccgcatgcagggaatacaaaaaaggaaactcatgcgttttgtcagtattaaacaagggtattcctctgattttgtgcatattcacagccttctttctttctcttttgcagcggctgtccattactttcactatagtccaaacaaaaccgcatgtcaatattttaatgaaattataaatacatttaaccaaagttgtatgtgtacaagttatcaaagacataactatagttatgttatcattcacagccctctggatcccgctccggtgctcttgcgctgtccccgccctgctttgccggattccgccgccccactgtccatcctgtgctgcgccggcctgcaaggattcctgtaaggggcgttataagcacaccggtccttaggctgcgtcttttgcagccttagtaccgctgtgtgcttatccgagcggaagcgtcccctgtaaggaaccttgcaggccggcgcggcacaggatggacagtggggcggcggaatccggcaaagcagggcagggacagcgcaagggcaccggagcgggatccagagggctgtgaatgataacataattttccatgtcatgaatatctcagggaatacataaactgttaaaaaccccccaaggaattagttctttgaaaaaacgcatgccactcatcattgccgccgcggcccttctccttttttcggggctgtttctttttttatacttctataacgataccctccgcttccatcacatgactgaagaattttttgccgaagcctttcggcaggatagcctgagccttcattatactctggcggaaccttctgattaccttcagaaaccatctcctgcaacgcttcccctgtactccagacagtcacgccaggaagcggcagccgcactggagaaccagcttcttatcctgcaggaaatcaatccggaaaggctgaaccagcaggatcgttatacctggtccctgctcgtcccttatctggaaaatgaactggcaggcgcccgctgtgaatactatgaagaaccccttaccccgtcctccggaatgcagtcgcagcttcccgtcctgctggccgaatattccttccgcaccaaagaggatctggaggattacctggagattctggaaagcgtacctgcctatctggaaagccttgcccaatatgaaaaggaaaaagccaatgccggattattcatgacagaatcagatgccagtaacattgtaaagcagtgcgacaccattatggatcccgatctgctctccgcaggagagcattttctgcagaccacttttcaggagcgtgcagaagcccttgtacaggagggattgctgaccgaagaagaaatggagctctacatagccgaaaacaaccggattctcaccaccctggtagccccggcttatattgccctggctgacgctgtttttcttctctccggaagcggcacacacgagggcggactctgtgaacttccgtcgggaggcgcttattacctctaccttctgcggcgcaataccggtacctcccggactcctgaagaaatacaggtcctgctgtcggaccggttccagttatgctatcagaaccttcaggccctggtagaaacctatcgggaacagacaggaaatacctccatttcccttcaggacattcctgcctttccttttcaggatgcccaggaagtccttgcagatttacagcagcggatccaaacggattttcctccgcttgatgcacttaccaaaactctgccgacctgccggacaaagactgttgcggaatccatggaggaatttacaagccctgccttttacctcacaccgcccattgatgatatgggagacaacgtaatttatgtaaataacgcttccacctccccggggctggagctgtacaccacgctggcccatgagggttatcccggccatttataccagaccgtatacagccagctatatgaaaattcccggaccaaaaatcctgtgagaagcgcccttttctatggcggttttgtggagggatgggcttattacgtggaaaatatctcctacggctatgcctccgacgtccttctcgccaacggagcctccaacatcacccctctgctggttgatatcgcctgtctggaacgcaaccttcaggtaaacctttactgtcttttagatctgtctatccattattacggcgccaccagacaggatatttatcgttccctggctgccttcggcatctccgataaggataccgcggacgctatttatgactatatccggaccgagcctaccacttacctgaaatattatctgggatacctggaaattctgtctctgcaggataaggccaaggagctctggggacaggattatacccctcttcgttttcatacctttcttcttcaggcagggccttcagacttttccaatctggaaaaacggctgacggaaacgccgattacacgaaccactattgcttatacgcagacggaaaagaaattggccatgtgttctttttccgggtagaaaaacggatgctacgctctgcaattcattcttatgttcaaataaaggctctgccagtatcccgcacactgacagagccttcttcttttatttcttcccattctgtatcccctggaaaaacccgagcaagttccccagagacttctccagcacggcctgttcgtcttcactcagcccttccaccaccatctgtatcatctcatcatgaaaccttttatgatgggcaaatcccttcttccctttagcagtcagggaaataagaaccacacgccgatcttcctcactcctgacacgatccacatatccttttttcaccaggctgtttacagagattgtaagagttcccgtagttactgcaagagccttggccacggaagtcatattcctggccgcaccggtacctatggcctcaatgacgtgcatgtcgttggtggtcatatccttatattcttccgtgcggatggcctgctcctcaatcgcgttgatgctgcggaacagcttcaccaacagttcattgagtgtttcattgatatccaacggggcttcctcctttgcctgcagcaagacttctttatcagtcatccttacaacgatcacttatcttctctattataatttactccactccatatttcaaccaaaatgctttgaaactcaaatattcatttattttccagttatccgggattaatccctatcctttcctactccactgatttcatggattccgccatattgatgccgtccagctttttgttcatagcccagtccacaatccccgcgaacacaaaggtgagaacaatactgtacaggacactgaggggcgcaatatgcacgtcaaaagcaatcatatcaatatcgatattatacatgacaaactgatggagataccgccccattatcagccccactccggcgcctattccggtcagcaccaggttttcccggaatacatagctcgcggtttccctgcggtaaaagcccagcaccttgatagtggcgatctccctcagtctttccgttatattgatattggtcagattatacagcacgataaatgcgagggaacccgcgcagccgataatcagaagcactacataatccaggctcttcatcatactgctgaaacgcactttcatatcggcgtttacggtaacggaagccacgccgtcacagttcattacggcagcggatacgctgtggacatccttttcttctttcacattgatataagcgcttttgtattccggcgcactcccaatctgctccgtccaggtttccgggctgatataggcataattatagacataattttcactgatgccggaaaccttcagcttcagtgtattcatatcgtcatcctgcagggtaaccatatctccgataccggccccgcatttatcagccagcttttccgtaagaaccacttcgcccttacccgggaaagcgatcggcacatcacgtgttgtatgcagattcagaaaagaagaaatatcctccgctttttcgggaatcaccagagtaagcgacttgcttttgtcacccttagtcaaatccgtactctcttcaaaaacaagagtatacttttccgcactctccgccatgatttcttcaaaatcactgttgtccatttcataccatggatcattgaaaaccacactcatatcatttatctggatttcatcaaactggttgtaggtaatgcttttaatagaatctttgattccaaaaccggtcagcagcagcgccgtacagccgccgatgccgaaaaccatcatgtaaaaacgctgtttataccggaaaatattcctggcagaaaccttccgcagaaatttcatacggttccataaaaagggaatacgctccagaatgatccgcttgccgcttttcggggctttgggacgcatcagttcggccgccacactggtcagctcatagcggcaggtggcaatcgttgttcccatggagcacaaaatggagacgataagggatattaaccccagcttccagtccagaataatccggatatcccccagccggtacatgatccggtacgcgctccagataactacagggaaaatataggaaccaagcaggaatccgatgccgcagcccagtacggcggcgcttcctgaataaaacagatatttccccatgatagtgccttcgctgtagccaagtgccttcaggatacctatctgcgtcctctgctcctccaccatcctcgtcatggtagtaatacacaccagcgcagccaccaggaaaaagaaaataggaaatacattggaaattccctctacaatatccgaatcgctttcaaaacatgcataaccgatatttttatcccggcccagcacataggtttccggctccttcaaatccgccagtttttctctggcatcatccagctccttccttgcatccgccgtctcatccgccagcttctgccggttttcttcatattcctcccagccgtccgacagttctttttcagcgtcttccagctctttttccgcatcctccagttttttctcttccctggctattttattttcagccgcctccagctgccggcttcccatattggcctgggcaagccctgcctctacctgggctttctttccctttacctgcgcttccttcagattcaggccggcttcgtaagcatccttttcatcgccgtcctccatatccgaagcctctatcctcttttcctccagaagctccaggccatctgctatttcagcctttccatcctccaattcagacagggaatccgtcactttctgccggttttctccgatttccgctctggcatcggcgatctcctgccagccgtctgctatttcctttttggcatcctctatttccttttctccgtccagaagctcatctttggcatccgccagcttttcatccgcctcggacacccgtttctccagctcccgttcgccgtcggcgatctgccactccgcgtcctccttaagcctttcataacgtgcctgggccacatcctcacaaagcggttccgcccaatccatggcctcgtcaatataatccttatattcctggctgtagagagggaatttatccgtaagccgtatgaaaacctccgtataggtatccgtatcaaacccgtcctcaggtatataaatatagcccttcagcttgccattccccagggcggtgctacctctttcataattaatataataagaagcgtcacagatacccacaattttatattccctgccggcaaacatatctatagtatcttcttcattgttctcagaaacacggatggtggtaccgatatctttccgtgtaaagctcaggctgtccaccacacattcatccggcgccgtgggcattctcccttcctgcaccactacatggttttgtacccataacagcgaatgagcgcgcaggactgtttccgctccgctttcatccagagcgagaaaatccacatataccgcgccttcagcgatttccacaccttcgcggctgttcagttctttcacatcctgttcgtcgaaaccgaccgtagacagcaggcgcagatcatacaggttattcttctccagatactcaccgcccgccttaagcatggccggctttgttacctttaatcccgtaaaaaaaccaacccccagagctacaatggctaaaatagccatatagcgtcccaggctttctctgatttcccgtaaagttgtctttaatatggtagatttcattctatccctcttccgactgacaaacgattactagtactcattgctgcaatgcccgtgcaacgtcgtactaactgctaccattcaatttcttcaaccggcgtaatatggggattcatttccatgctgcgtatggtgccgctctttacccggataatacgatccgccatggccgtaatggcctgattatgggtaataaccaccacagtcatccctgtctcccggcaggtatcctgcagcagcttcaataccgcctttcctgtattataatccagcgcgcccgtaggctcatcacaaagcagcagcttgggattcttggcaagcgccctggcaattgccaccctctgctgctccccgccggaaagctgggcggggaaattggacattctctcctccagccccacctttttcaatgtttcccccgcatccagcgggttcctggatatctgtgatgccagctccacattttccagggctgtcagattctgaatcagattataaaactgaaatacaaaccctatttcatatcttctgtaggaagtcagctgcctctgattataagcagaaatttccttcccatccagtatgacctgcccctcggaaagagtatccatccctcccagaatatttaatatcgtggttttccctgccccggaagctcctacaataacgcagaattccccttcctgaatctcaaaattcacatcctgcagggcatggatatccacttctcccatatgatatactttttttacatttttaaattccacaaatgccataaccgtaccgccttcttccggcgttcaacacgcctgagtcatagaatgccccacagccggaggcagcgctctccggacgcattctaatcctgttcttccatcatgctgtcaatataacctctgtcccagagaagaatcttcagcttccctgctgccgcaaccgctgctgaagtaaaatactggtttgtcattaccgctcctaccatcctgtcataatagtcccggcccgcgtagacctcctgtacggctttcacgccgattggcgcattgtagcacttacactgaaccgcataagtcactccatccttttccgccaggatatccacaccgtaatctccgcttcccttcgtgacctccacatccaggaatccgtttttccgcagaagatccgcacaaaaatattcgaaatcatgcccttccatttcgtccatcagctggcttcttcttctgcgcttccacctccttgataccagaaaagcggcaaaaacaagaaccgccaggcccgctgcagacataatgctgataaaaataactgatgactgatccatataacgaaactccattatccgtatggccttctccggcctttattttattcttaaggacgcgccttctatcacaaaaagaaccagaccggctgtcttaccggcgccggctctgattcccctcatttacataatactcttttttcttctgatttcctagatataatttattaaatctctcttgtcattggaatatttatacgcattttcccgtgtgatcattcccagagacacaaggcgggcaagatctccgttcagcgtatgcataccgtttgccgcaccggactgcatgatggtggacatctgatgccccttgctttccctgatcagattcatgaccgcatccgttcccgtaagcagctccgttgccgctgtccgtccccttccgtccgccgtggggatcagacactgggtaatgatccctttcagcactccggaaagctggatgcgtacctggttctggctggaggccgggcaggcgtcaataatacggtctatcgtctgcgccgcccctgtggtatgaagggtggaaagcaccagatgcccggtttccgcagctgtcagggcggcggaaatcgtttcataatccctcatttcccctaccagaatgatatccggatcctcacgcagggcagaacgcagagcagcggcaaaagaggaaacatcccttcccacctctctctgatggatcagcgcctgctttctttcatacatatactcaattggatcctctatcgtaatgatatgctccggcctggaggcattcacataatcaatcatggccgccagggtagtggacttaccgcttcccgtaggccctgttaccaatatcagccctctcggttcatcggccagctgtttcagtatgggcggaagctgcagctcttctatggtgggaatgcgatcattgagcagacggatggtgcaggccagctttccctgctgccggaaaatattcacacgttctcttcccccatccggcgactgtatggcaaaatccacatctcttccttctgaaaattccttctgcagccatgcatccggcatctggaggatcatctgccgggtctcttcctctcccggctggacaggcgcatacaccagcgttccttttactcttatcagcatgggcagcccttccgacaaatgaatatccgagcagcctgtctgccgtcccatggcaatgattgtatgaatgtccattcatgactccttccgggttcttctctcttttaacagtttaacagcattctcctgcgttatgcataataggcaaccttcatcagctcttccatagtggtcactcccgcttccaccagttccacgccgcattccttcagggttttcatcccctgcttttcaatggcatagtccttgacctcctccatggtggctctgcgggatatcatttcccggatcggcctgtcgatggtgaggatttcatggatggcggtacgtcccttataccccgtattattacaataccggcatcctttgggacgcattaccttaggaatatcacgttccaggaattcccgctcctcttccgtcggttcttccgcctgtgcgcagtacggacatactttgcgcatcagcctctgggctaccacacctaccagggaattggcgatcatatacggttccagccccatgtccacaagccggatgactgaggatacggaatcattggtatgaagcgttgaaaaaacaagatgtccggtaatagcggcacgcacggatatagacgccgtctccgcatcacgcgtctctcccaccatgataatatccggatcctgacgcagaagggcgcgaagccccgactcaaaggttactccggccagagcattcacctgcatctgattgattctcggcacatttttttcaaccggatcctcaatggtggagatattcacctgcttttccgacatctcctccagtatcatatacaaagtcgtggactttccgcttcccgtagggcctgtcagataaataatcccgttgggtgaacgcagaagcctgcggaatttctgataatcagaatccttcattccaaaagaagccggatgatcaatcgccgcatttcccgtcagcagacgcagcaccgccttttctccgaaaacagtaggaatcacagagacacggatattaatcatctcatcctttacctgagtcctgaaatgtccgtcctgcggggcgcgcctttcggcaatatccaaatcagacaaaatcttgatacgcgctatcagggaagcatgaagctgcttctgaagggtgacatattccgtgatcgttccgtccagacgcatacggaccgttgtcttatgctcgaagggttcgatatggatatcgctggcgttggtattcgctgctctctcgatcaaagtgttcagcaggttgatgacaggggtatcgtcatccgcttcttcaatctgcagttcctccaccatatcttcactgcttgtatttgccttcttagccgccattttggcggatacctcggaataataataggaaatggcattttccagcgcgtatttttcacacagctggatttctgtctgcatacctgttatctgacggatatcctcaatgccataataattcagcggatcattggtgatcaccgtgagccgatccccatttttgctgactgccagcatcagatacctctctgccagctgccttggaatcatccccacagcatcaatatccaccgaaacagaggatatatctacggtctgcaaagccagcttggccgcaagggcttccactttctgaccttctgttataaattccagggctataagtgcatcccctattcgcataccaggattctgcttctggtattccacagccctttcgatctgttcttcggttacatacccggcttccttcagaagctgccccagcctgatatttttaattgacgctgtttccattattattcgtcccttttatacatatatatttccatctgaagctgcagggtatcattcaaagaagatacatactcccctgcctcattccgcaggctgctgttttctttgccccatacagcacccgtaatgcggatagccggataatcttcggatatttcatccgccatctgttccagcacactgcgctcgccctttacggtaagcattgcctgtgccgcatagatcccataaaaagaagtggaggttttccggacagtatccgtctgttcctccccatcctgcccaattgcctgtgaaagcatttcctcaagcgcagcctgagaagcataaaaagggtcaagtatcatctctccctcaggcatctgaataaccagctgccttgattccagtccccaggataatgcaatgcccgtaagaagcttgtcgatttcctgactcttcataaccgggtaaaaatcctcggcagcagcagccagctcctcctctgtcttttccacattagcctgcatggaaggcaggagcatcagcttctgctgagtacggatctgcagttcttcctgaactgccagctcttcctttaatgcggcatccgtctccgccagagggcgaatgataaaaaagccgaataccacaacgattacaaagattgccagaaacagaagcagctttttatctctatccgtaatttctgttgttatcttcacactgctctcctcctatttcccggcattttcagaaaggtagcaaaccagattgatggtccacatccctctctcttccgaccagacatagcccgtataatccagctgttcaaaaatgtccctttcctccagccgatcaatgaactggttgatatcctctacctccggcgcagcagtatccacattcacaatacctgtagctgcgtcaaagctcagcacttcaatcaccacctgccccaaagaacagctttctatttccttacggacagaactgttaaaggatggataggattctatattccttttagcccgttccagagatgctttcaaagtctggttccacataagacggctttccagctcatcatattgggcactttgctccagaacctcaggattttcattataatccctcacctcctgcagcctcttttgcgttatcaggcagtttcccacaaaaaaaccggtaatcatcagcataaccacaagaagaagcaataccggaatcagctgtttcatgaggcttatacgcttctgatggctctcagaactcttcttataccggtaatacagattgctttccttttccagcctgaacaggccgctgaccgcaaaaaggaaattgtccacagccccatcgccgaaacgtatcaccttttcatcttcaagcatatcggccttcaaatcgggatccatctgttccaaagcctgcgcacatacctgcatatccctttccgggaagcccgcccagaaaacatccgtcaccgaattttccagcttttgggcggaggcaaactgaaggataccgctgatatttctcgccacctccataccatagccttccgtcccgtgctcgctgaaggtacggctcacgctggaataacagtaaatacccttatccaacagaatactggtcagattatcttcatcctgtatctgaaccacacaggtttttccccttaccagctccatctgatgaagaacggatactacacatccaagggctgcctgtacagaatttatctggattcccacagaagcaaacagcttcctgtaggagtccaggaaatctctttccatacgggtggcaaaaacctcccgcattcccttccccttattcccagaaatccggaaataaccataaacactcccggaatcattattcactcccgggaactccctctggatatagtttaatgttttattcgtattcatggcgggaatcatcagtgttttagccataaactgagaactgtgcagtaccaggcagacattcctggtggaaagatggttttctttccaaaactgacttaaatgtgccccaagctcttcttctccggttattacaccattgatgatgcttccctccggcgcctccgtctcatacagccttttcactgctatggaatgattttttggatttccgaccgccacctgtatcttgcggttggacatatatacacaagtctgcatgcaggcattgtcctttctgttaatatcccgaattgcttattgcatcataagaaccataaataggcatgagtacggaaatcataatgaaccctactataattgccatcactacaatcaataccggctccagagtggccaccattctgtcgacggccatattggattcatattccatggaatccgcgatagaattcagcatcgtatccaggcttcccgtttcttctcccaccctgacggcagaagtcagtttctttgtaaacccttttatattatccagggcatccgataaattccctccggagcgtactttggcaaccgcatcatcaaactggctgtctatatatgtgttgccgattgtttttctcccgatctgcagcgcctgtacaataggtattcccgaagaatacagagaactgattgttctggcaaagcgggccgtatagataatcatcagaagctttccaaacacaggaagcttgattttcagtttatccaattgaagttttaccgagggcatatgacagataaatatagtggccggaatcaaaaatgccagaagaatcaatagaatcatccagtgattctttaccccatcactcataaagaacaaaatcttcgtaggcacaggcagctcttccatctgatcaaagagatcctgaaactgcggcaggatatagctcagcatgaatattactacgacgacaatgactccgcttagaattttaggataaagtgtagaattgctgattttagtgttcagccggaattgcttgtcataaaaatccgccatgcgcatggcggtttcatccagatttcccgccgtttccgctgaacggaacatattaatcaaaagctcaggaaatgcctctccctgatcctccatggcatccgataaagccgttccctgccttacctgacgcagcagattttcaaataccgttttctcattgggcttattcgtctcatcctgagccacaatattcaatgccctcacaagggaaacaccggaagccgaaagcgtgcctatctgcctgcagaaatcagacagatatttagccttaatcctgcgaagtctcttcgcttcttcttcccgtttggcattgaccagatatttattatcagcctgcagcttctggtgcagatctctttcatccgccgcctgcagaagcccggtcactaattttccattttcgtccttagccttataactgtacttaggcatattgtttcctttcgtgccgctatcttcaataaagcaatcccatataccagttcaatacccaatcccccacaaacaaagcggccgccatgcctacacaaagaaaaggcccgaaggcaaaatgctccttgcctccctttttccttgtaagcagaagccagatcccatacaggccccccgtcaaaaccgcaaaagccagagaaaggaggcacaatttcgcccccagaaaaagtccgcagcccgccatcagcttaatatcccctccgccaaaagctcccggcacggcgagtgtaagcagcaaaagcggtacgcttaccgcaaaaataccaatgattctggaaaggatactcgtgtccggcatggtaaaaactgacagaagccctgatgcaaaggctgctgccacaaaagaatcaggaatctccatggtatcccagtccacaaaccccaccaccaggagaagccccaggaaaagaatcaccgtcactgatgctgcggggcttccaaagtatatttgggataccactgctgcagcgccgcccaaaactatgcttatcagatacctgggccggaatccagctttgcggaatgcccgatagccttctttgaatcccaactttcttggcaccagatatattatcccgttcaaaagataaaaaaagcaggcgcctgctacaaacaccaacatatataataaaatactccctgtcagcagcattacatgtccccgcaattccggtctgtcttacaaaccatctcttttgcttattatagattatccgcaggaaagagacaataatattttcctatataaacttcctgcccggatatcattatgataccgggcagaaaaactatcctgtctctttattagctgaatggaacctttcgttcccgaccacttattcttcacccagagccattacctttttcagacggtagatgttccattccggctcatctcttttcacatcgtattcgtagactgcaagaaatgaatccgtctgataaaagaacttgccaggtaaagctttgtcgtaattccagtatactaacgttatttctccattggcgccggagagatattcaatctcattaagtgtatcttcagccataccaaaaggttcacctggttgataaatattgcgatcctgtccataatactgaatggagagaagtctcatagccaactgaatatttttggcatcgtccagaacaaatctggcccttgtataattatcgtaacaataagctgcaggtgacaaacaaaatacacatagcaatataattatgattaacaccttaaaccctgtgcttaaatttattttattatgcattatagttactcttttgtttgtacctctccccagccattttcatatgtataaataatatatttattattttccacatatttcatagccatcaattctccggtattttcatttatcgtatctttatcataccaaaaatcatcttttttaggatcaattaatattttaccattttgaggaatacccgttatctcaatatccgttatagttccgtccaaatccgtaaaataataatagcgctttgcagtaaactcatctttgcttaaatttgcgtaatcttcaataagttgttcctgtaaagcaatatatgcggatcgtgcatttacctcaatttgtttgtcctttgctttgtcgataaatgaaatcaaacctggtattaaaattgctaaaagaatagaaaggataactataacaactatcatttcaactaatgtgaagccgtcattttctttacgtatactttttagcatttttacctcattaatctaaatcaaatatacttataatattattatattcttattcgacttctttccattcgcccccttctatcttaacggttttcttagaagcatcatcagtataagtcattgcggttatccctttatccttttcatatgtaacaccagatactgttccagttgcagttttcacatcattagcagcatcctgtgcagcctctatatctccacctggtaatccataagcttctgctgcagcagttgttgcgtccatatatgcagcatgagcatttaccataatctgcttatctttcgctttatcaatatacttaatcataccaggaactaatattgccagcaaaataccaagaataacaataacaacaatcatttcaatcagggtaaatccctttttatcttttttcaatctctcaactaaattcatatccatttccttccaatctttttcctatttaatattcctacagtaactaaaataccctgtctgaaaccctgcgccatttaaacctttatcacaatatatctgccgtgtatcagcacagttccataagacagcaattgcggatatcccatatccgtttcttacttcctgcctccttcacctttaatcttcggatttttaatcccttactaacaatttccgtactccggataatcccatactttattgtcgatatacaaaggaaaactccactctgcagttcccctttagataccgttttattacatacaagattcctagtatcattaatataaacttttcgacactaattgtcaacatttcctgtttttttttacaaatatacgaaattttattaatcttttataaattttgcactctaatttgcacactttatttgagactggcaataattgttcaaattttagttacatttatattttgggcttccatatttctgcatttcactattctgctcaccgtaagagggctgaaatgagtcttcgcattttctaatgtaacagtaatccggatcaggtttttatcttcttccactttctcaattttgaattccgttaagaccgttcccatatatgatggctttccatagtaccagttcgtatattccgtgtttttatcaccggttaccggatcaattgccttcgtgcagtaacgaagaagcagcatctgatccatgactgcattttcatccagtccggctcgatccgatggggacagtataatatcaccaagcattcccatggttacctgaatgccctcctcattccgaaacacagcgatgtcatgcctgctgccgccggacgcctgactctgatagatatacaaagagtattcttctgcgagtttctcctcatcatctttttccggagagaacaccccgccctgtccgccggataattcacctgctgcttttgttaaaagtacatctgcaacattctgagcgcttgaaatgctttttacccgtgcaaatacatgcataaaggaagacattacggcagttgctgacaccatgaaaattccgataaggacaaaggtaactatcagttctatgagcgtaaagccttttttattccgcagttttttccaaatccacattttcatcagtccttatcaaaataatagtactcatagctgatattatcttctgtatatgtttttgcatatccccgggagttatttatttttaactgtatatcctttccattcacaggaaccagtgtgaagttctgagacactaaaatccctttctcctcttttagataatattcctccacggcactctcaataaccttccttttggccccggactcatttatcagcttcaaagaaacagtggtggacgtcgtcatcatcaggatacccagcatgaggatggaaaaggccaccatcacagatacaatggaggtaccttttttatctgcaagtaattttttcccattagctacgcttttacgaaaatccatttatattcctcctctccgcttactcccataattcccatctgatatttctgccggatatgatagctgtcatttcccttactgcaggtaactaccgtatataaaaataaatctccaaattttttggactcagtctgactaactttacgtcggtcagcatcctctttttccatatttgatacatcgccaaaatagattgttaccgtaatatcataaccccgaatcgtatcccctacagacgccccattatctgtttccggttcaaattcccataccaaaccttctttttctttgtaccagcagaaattaaaatcagcgtcactgagcagcaaatctctgatatttgtctgaaattcagtaacctttgtactatctgtcaaatctttgccaatcatctcactgaaactttccgccgccagacggcagcgggtaagcgcggcatttttcttcagagaaccggttaccgcagatacggataggagcatggcaagagacagcgcggtaaacagaaacatgagacaaaccaccactatcatggcgtctcctcttgtatcttttatgttattcctgaaatctttctttctgttcctatcactcattgcccggctctccctccttcttcattcctgaatccggcaggctttcattctctgtactgatttctgaaaaagccgtggactgtgtatgtacttccgtatccggctcatctgtctgagagccggtatggctctcagactccgtccggatttctgcagcagattccgtttcggtttccgtttccttttcgggaacggtttctgtgcttgtctgggactctgtttccttttcttcttctgtactggtttctgtttctattgtattacctgatacggaattctgaggctttttgtccggcagggtatttcccgatatggtgttgctcctgcctgcgtaagttacagaattattatctttacatataacaataggcagagggtcagattttacactatatacatcatatccgttatgagaattgctgtcccatgtttcaataaccttttgcaggttttctaccgtttcacccttttcccaggttaacgttttgagttcttcaggctgccatatgcgaatgaggaaagctgtatcggaattcgtccatacgctttgattaccgaatgtctgtttaacagaaacagcggatgtaaacaaatactgcaatttctgatttgcccccgtatcaaacgtacttctgatatccggcagtatcagccggcagttatatactgtcttgccttctgtttcctcttcggtaatccttaaaacggcagagtgcctcgtgtcggaattttcccacggccatgcggcttcataggaaatagagtctatcgtatatcgatagaccttgtcctgttcttttttcatctctatatacgtatttccatctgaaacctttggctcctttcccttttcaaaagtaatagaaaccgtatgttcctttccggctaaatctctgacggcaatctggcaggttccttcttcatatttccatttccactccagcatatccctggaaatagtatgcgctcctatttgttcttcctctgttcctccgtttaataaaatagtgtcaggcttcactttgggaagccggtaaaccagataatcagaccataaggaactgattttctcattttctgttgccctgtatctgatgaccagatattttccggcaagtgtagaatcccacccggttaaattatctttgcttagtgtaaattcagcattaccatttgcatcctgtgaaatcaatttacaaggagactctgaaacaggagccagcggccgaactgaaattattccattctcatccaggaaagcctgatttacattgccatcatccgaaatgaaattcattccgtcatagctatccgcataaacagctgcctctgccttataatcccctgaaaacgtgttgctttgcagcctaaatttcataaccagatctttaaaatcatcctccttgtattccgaatcgaaaataatatctttatcctcttcatctgtcagactaacgctcaaatctccaggaatctccaggcgttcggacacttttaccttataatgctgtccttcttccgaatcacggtacttaccattttcttcaatggctcccgcattaacaaacagctctatttcccagccggcaaaggattccaggctgcagtttaattcctgattttcgcgataatctttatcatattcaggttcataaggtcctgccgcctttttcctgacagccagaagaactttgaagccttgaatattccctgaatcgtcagcaatttcttctactgccccgccataattcttctcaagagcttccttcagcgctgtcaccttctgctcattcgcacccatacaggaaacataggcatacagctgatactccttcaaacagcttcgctgtgattcctccgcgatacgattccagtaaatatcataatttaattcatcatgagtgctgagttcaacagttccccaggtaacttttgaaagctttctgtggaattcctgtacagacttgctatatagcttgtcacttaccagccgtgtctgattaaaggaatctgtaatctccttctggctccccagtctggtaacctccagccgtattgctttgtaactggtttcccaatcgaagcccgtcagtgtaaggcttgcctgttctgtttccttcaaactgtacagattcacttcactgccgtcttcccggacacctgtcagatttacctgatatttcgcactgctgtctctctgtctgccgtcccagcggaaagtaactgaatcaccatcttgttcatattcatctgaaattaccggaacaggctgctttaagctttctgttttaacttccactttccggtattgagcagacatcgtgtctgtattctttaataccagtctgtaatatacattatataagggttctccgtcacttcgaacacctgcacgttctataacatatccgtcatttaccaaatagcgcgctttagtccccgttgttgttagttcaaatgttccttttttggttaaatatttactatttgaggtaagctctcttgccgtcagtggctgtgtattcaaaggatttctgcttccaagataacaaaccggtatctgagactggccatctgccgccgttgtattgcctgatgcatatgcatacgttctgacggttatggtatttatttcatcacatacaccttccgcctggtatccggccagttcctggttcactcctgatatactgccataagtttcttcctcatttgacctgcctgaaaccgtatcactataacccgctacaacttcggtgccaagctgaggatcgaagataagcatctctgtcctgtatatagtactgcgatcctctgtcacactcttaagaagcgtatcatagcccagtgtgtccggtgaaattccggtcagataaggcgtatctttttgtaaactgatatccgtcacttttgatttcagataatcaccggtcagcatccattgctccatggtaaccataggagaatttaaaaactgtgtttcactatcttttcccggcaccatctggaaaccaattattgtatcctccagcaatgtgtctgagtcgaacagacttttctcaatatctaagactatttcatcatttaccacttggaaatccgatatagcagcttttttaatctcttcccatttatcccctgtctgttttgcaataatcagactgcaattcacaaactgctgccccgatttataagcatccgcattttccagatgcagggtccatttatccgttccgctgctgttatccctttccagatatatctccggagcaggcagcataggctgtacttttataaaggcattattattctcatccgtatagtatatctcatccgaatcatacttttctccgaaaatactcttggcctttatggaaacacgcaaatataagcccgcccaatccatagatggggtgataaacgtttctgtccccagaggaatataagcactgctgcccataccattcaccctggtgctttcatctttagcactatacaaggacgcatttacttcatagccgtaggcctctgccacagaattccaggtgacatgatactggctgtttttcaattccaccttgattccctgagggttatccagtttttccaccactctgtctttccagtgaagctgatcatcgatcttcagatataactccttaccggttccattccaggtacatgggtttgccgacatttcacggatgaaaggcacattgtcaagcctgctcttcttataggcattccagttttctgcattcggattcttcttcacatacaaaggctctgcaattcctcttttctgtgcttcttcaggcggcagctgggtgttatccacagaaatatcccagacagaatattcattcaaagactgattttcgtctccttcatatccttttaagttgataataatggtttttactttttcattcttccagccatttgcactctccagagatacttcattacaattttcaatagagactcccgcatccttatttcctgcggcttctcctgtccaataattagcgcttccattaccggaaggcgtcaggtccaccctttctccgtgttcatattctacagtaatagtaaacttcaccgttctcttctcatcattctcccggaaccaggaaatacgcagggaattcgtatctatagccgttttatttccgtccttatccaaaaaatcaagacgtatatgagaatcctctgatttttggataattccacgcgtacggttatcattatcaaccacattggcagcattatttttattggatccggaatatggtgacagaacagccgacaccgtattcccgtcaaaggaagccggctgtgtgaaaaaataattattgtcacaatcccccggtctgagggaatcagaagccaccggattttccaaatccgatacattaatacattctgatatcttcagatacttttccgcttcgaaagcaccacttccctgatcaccggtttctcccagaatcccctgcattttatcattctggttcaatggcttcccataattgcggcagtcatttaccgtgatgtttccaccattggcttttccatccaatattcctataatcccgcctgtgacagatgattttccgtcaagatccgcagtattcacacaatttcgaattaataaagctccattgttcataccggagattctgcccgtcacacctgacgcgtttttcccatatacagccccgtgattcacacagttttccatactgatattattgggaccgtccgttacatctacgatacccacaatacctccggcatttgggctgccttcgatcttcccattattttcacagccggaaacaacagcctccccggacacaagcccaataatccctccgattccggtaacacccgttcctgttatcagtacatttccggaaaaactgcagtccgtgatttttccccggctctctcctgcaataccaccggcagcgccggtacctccggatataagaatactggcctccgctttggctgcgtttatggttcccctgttaatcccggcaataccgcctgcccggtaagtatatcctgataatttcacctttacttcagaagcgctgacactcccggcattaaagccggcaacacctcctatacagccattctctgactgtatatctccgttcatcgtcagtacatcagcaagagtgcttatacttccgaaattttcagccgtaattcctcctgccattctgcttccgataactgttccggaaaccacacaatcaacaatttctccttcagccgtattctttccggtaattcctccggcataagctccctggaactgttccggcagatttacctgacagcgtataatagtaccggaatttacttctgtcagatttccataataggtcgttcccagggcatgtatagcgacattgcccgtattcacacaattatcgatagtcacattggctcctgccgtaccaataattccgcctgtgtaagaataatttaccgggtcaccgccttcagatatataaggcctccccgttcctccctgataggaaagtgatgcctgtgtatatccgccgatattccggcttcccagggaagtaagatccgtggaagcaacatttccttcagaacgtaccgttgctttattcacaagtccccgcagctccagctgggtatccggggcgctgtatcctacgataccgcccaccataacgccgccgctgacctcacccacaccattgatatgggttccttttcctgtattgggagttatttcactggcgtcattcgttgtatccacaatatacatcttcccggttccggcggactgggctgtctctgcttcccattggaatactgcatttatcatacccgtgagatccttcgcataagtgccggaaatatccaccagatagtccgctgcctccctgatgctcccacgaatctgggaagaattcccctgggccgtcataagcctgttatagccaatgcagccccctgccataccgcccaccatttttacggtaccgttataaacagcagtcactttgcccagctgattaccggtcctgcactgaagataccaatcctttccgtccgcaccgttcacggctgccagattgcctcctattaatcctccgacaaaccatatacctgaaaccatatccggatcagcctgaagcagcatatttcctgcctcatcctccgtatcggaaaaaatagacttcgatacattacagccgatcagacctccgacaaaggcttccccttctacatagcctcccttaaggctgtagtttttcaaatccacaaccccattcacgtcattatatccaatcaggccgcccacatagttggtgcctaccaccatatccgtattaaatcttctgatactgctttccacaataccattattataacctgcaagccctccggtacacccttttgtgctgaagctgaaccattgtgtgatggcagatgcatattctttccactctatcccggtaagctccttcatacttgtacaatcaatcagctgacctgcattaaagccggttattccgcctgcatacccgttagaagaaatgataattcccttgtttttccagtttttaacaattctcatttcctcataatcttcgacaggcttctgtttcgcatccagggacgcattcgcgcccagaattcctccggcgtactgaaaagcgatgatatccgcattattttccgaaccttcaccatccagcacggtcattccttttccgttttcatattccagatatcccgcaatgcctcctacaaaatagtggcctcgcagaacacctcctttggtggaacaattctttattcttgttcctgccgtaccatatccgatgatacctcccatataatctccgacgaacgcatcttcatcaagctcgtccattgtatcgctcacagacttcatagaatagaaatcttttttcccaagagtactctcacagtctgaaagccctacaccatatgcatagccgacaattccacccagatacagggatgttctctttttacccttctcccctgtaattgtcccttcgtttacacacttttcaatcaaactgccgctgtcagtcaactcctcatttccaaaacaggatgcgccgataatacctccaacataagaattccctctgatcggagccccattgtacaatcgtttataccctgacggttcctgcccttttccttctgttttcagatattgctcatccaccgtactgtctttcagcagcagtaaatcccctcctgtaataccgccgacaaactgaatacccttcacatagctcagttccgtctcttccttctccatcttgtcagacacttcgtcactcagcctgactgatatatgggacactgctccccggtttactccgcagaccgtacccacataattctgtccttccacctttacgtcggaaaaatccacatgagaaatcttaccttcattccagcggaaaagaccaagggcataattttttacttccgtataatcaaatactgatgctgcatttttttcatacagtgtcaatccgaatatctggtgatttccggacaagatagattttttagccgaataaatgctgttttctctcaatatgggattggcaggaaaaggaattccttcctcattgctgtaatccgcattgtataaggcatcgggattaatctgccactccccctgctgcccggagctatcataaagcatgtaatggcccaccagtccgtcagcgcctccccagccaaaatctgcggtctgactgtagctgaccattttttgatctgtgctgcccgatttgaccttcagtccataaaatatttccgtaaaacgaatattaaataaatgtcgtgcattctgtatgtcatacgtaacagacgtatcgccgctgattaccttttccttccccatcaacggattttgaacagtatctgttgtcttaaccctggcgtcactaagatccagacctgcacgggatagaatataaatagtttccgtgtcaaacgggatcccgaaggaagatgtatccgctcccataaagcggaggatacttgccgtattctgataaaaagcggaatccagaagctcctcataggtttcatttccagccacagctgcacgattcttttcatcaaggattcttgccgcctctaaatcaacagcatccagtacaatacagatttccttattttcattaacggttatctgcagcggatattctttagggatttcttcttggttcttttcattaaatctggctacctttacattgacagtatgggttgtcgcagtattattatcattgtctcccaaatcgcttcccttgatataaaaagcaaggcgttttttagttgaatcatcaaaaacctcaaagccatagttgtatttcagcatgaaccgttcatattttgaggcaagcttcagccggagtacgagtgtttccccattctccagtaccgccttctggaaagaaggctttccatagctttctatcggagcctgttcggacagaacggtatcataatagccgagcatctgctttctgcgcagaccctcgtcttcacgtatcctggcatttatacccatggttttcccgtcagaaccgtcatcctccgaataattaaaggcgttcacccgatccgtgtagctcagggaataaacagtcccttccccagggtcaaattccagccggatagccgcctgaaaaattttctgatcatatacataattgcacaaaagctgatagagcctgtttccctccaggttatcgctttcatctgctttgatatccagataatacagggatctggatgcgtcataaccctgtaccactccggatcctgcgccgccattttccacataggcaaacagctctccggagtttccggcggctgcttcctgggcgagcgccgtctgagcggcaataaacagggtctgggcatattcattgttccttttataaatggaattacggttccaggaggcgatccccattactgcaccggtgagaaggattgacaggattacaagagttacaattacctctacaagagtaaaaccagaaatctcttctattattgtatatcttaaatcagaagctttatgctctttcatttttatcctttaccttaaatatacctaactgatttttcgaaaaattatacgggatacagaataatccaattacttccgtccgtctccatcgggaagccatcccattctcccttttcgatgtcaatccctacccgcaggaaatattggccattataaagaaagacagttcctgttttcaccttactattcatactataatttccggaatcttcagtgatttcattttgaaaatcatatattgttttactgctcccatttgcatcactgggtatctctttcatcaaattactgttttcacctttaggattatccaacaaattattctctttggcatatgcaaacttattattcgataatttataaatatgatattgttctaattccacactcccctgtgcatcctccaggttaacatgataataaaactctttcccacctattacaaaagttccgtcatttatcatctcaaccggctgtttttccggctctgtcggaacagaagattctatcgttccttcctctgtcggcagcgcagactcttcttccggaatttcaacaagttctccgcccgccttgtcaccggccgcagacaaagcactatccttcccatgcacactgcattccaccgtattatcatccggcgcacggtacaccccgcccgaaggacagctgatatccgtattttcagcaagcaccccagccattaccgcaccggggttcagcgccctgtctgattccagccgggcaagtaaagcctttctgtttatctcgcagtctcttttcttcccatcatcaatatatttagccagggaaggaaccgtaattgctgccagaattcccaccaccaccataacaacaacaatttccaccagggtaaatccctttttacccatacttctcataaggtacctcttttcacgaacaagggcagatccgccctattattgagattacttcatcataccataacaaaaattgttacacaagcaggttaattccatacgaaaaatgatcttatgtaatcctgtatcaaaaactattttttctattgacttccccaattttcttttatatgctggtagcgtatatactataaatgagggggaacctttaatggaaaaaagagagaaattctcgtcacggctgggatttattctgatttcagccggctgtgctgtcggccttggcaatgtatggcgttttccttacattaccggaaaatatggtggggcagcttttgtattaatttatcttgtatttcttgttattctaggcctgcctattatggtaatggaattttccgtaggaaggagcagccagaaatccgctgccagaagctttcatgccctggagcctgccggcaccaaatggcatttcctgtcttacattgccatcgccggaaattacctgctgatgatgttttatactacggtaggcggctggatgctttcctatgttgtaaaaatgattaagggagaatttacgggtctggacccggacgctgtgggcgccgtatttaataacatgcttacccgtcccggctccatggccttctggatgattttgaccgttgtaatcagctttcttgtatgcagcctgggacttcaaaaaggtgtggaacggattacaaagttcatgatgggatccctttttgttatcctgatcatcctctgtatccgaagcgtaaccttacccggcgctgcggacggagccgccttctatctgattcccgatttcagtaaaattaaagaatacggatggtttgacgttatcttcgccgctatgggacaggctttctttaccctgagtttaggaatcggcgcaatggctatcttcggcagctatattgcaaaggatcacacgcttacaggagaatccatacgtatctgtcttttggacaccctggtggccctgttggccggcttaatcattttcccggcctgctttgcttttaaagtaaatcccggagaaggccccggcctggtattcgtaaccctgcccaatatcttcaaccagatggccggcggaaggattttcggaaccctgttctttgtatttatgagcttcgccgccctttccaccattatagcggtatttgaaaatatcatcagcttttccatagacctgttcagttggaaaagaggtaaggcggtcgcggtaaatctggtgttgattatcgtcctctcccttccctgtgtcttcggcttcaatatctggagctccatcgctccgctgggagccggttccacaatccaggatctggaggattttatcgtttccaacaatcttctgccattaggtagcctcggctatcttctgttttgtaccagccgttacggctggggctggaaaaattttattgcggaagccgacgccggcaaaggtgccaaattccctcagtggtcccgcatttatgtaagctttatccttcctgccattgtactgtttatctttatcatgggatatatacaaaaatttgttaaataacgaaagaaaaagggctatcggatagatagccctgaatttttccttatcagctcagggaaaattgtatatttaatttaatggttttcttttcaaattgtaaaataagacggaatatgctatatttgagatatcacacaaattgtccgattatccttcaaagctataaacctataatatattacattatttgaaagagaggtatatcaaacatgaacaggcttgaaaacaaggtagccatcatcaccggagggaattccggaatcggggaagcatgtgcactgctttttgccaaagaaggcgcaaaggtagttatcactgcaagaagagaggctcagttggaagaggttgccgcgaaagtacgcgaggcaggcggcgacgtccttgcggtaaggaccgatatttccaattctgaagatgtaaagaaaatgattgataagacgattgaagcctacggaaagctggacattattatcaataatgcaggtgttctggaggaaggacttctccccattgatcgtgtcaaaaacgaagatatggactaccttatggatatcaacaccaagggaaccatgaactgcatgcgcgaagcaagccgtctcatgctggaacagggcagcggctccatcgtaaatgtagcttccgttgcaggtgttgccggaaacggcggcgccgcctatgttgcgagcaaagctgccgtggtaggcgttacccgccataccgctatgcgctgtgcatccaaaaatgtgcgctgtaacgttatctgtcccggtaatgtaatcactcccatgactatgaatctgaatcctgccgctctggatcctgatatgatgggcgccatggcttcccatggggatatgaggcttccttcctgtcaggctgaggatgttgccaatattgctctgttcctggcgagcgatgagtccagggctgtcacagggcagactatcgtttctgacttcggatgcaccttataaaaacacaaaaggaaaccggacaacagcggggctgagatgccccggcggttgtccggttattttatttcacgaaacacttctgatttcttcccgccgattcttttcccttacagaaaaattccgcattatcccagcatcccggccagcactacactggcagcaattccagccgccgtagcagtcagcgcccccgccagcgtataccgggtctttgtaaccttagccgccataaaataaacgctcattgtataaaagcaggtttccgtacagctcatcagaatagaggtcatcattccaatataggaatccgtcccataattcttaaaaatatccagcaccagcccggtagccgcagaggatgaaaaaagcttgataaaaataagaggcacaatgggagcaggcagtcccatgggttcggttatctttccaatcagccctccaaaaaactccaggaaaccggaagcccgcaatatccccaccgccatcatcagcccaatcagcgtaggcatgatctttataaccgtatgaaagccatcctccgcccccttgataaagtcttcatatacgttcgtatgatgaatcaccccataagccacgatataaaatatcagggccggaattatgatattggataggttcgccagcgcattcatcataaaagaggatacctcggcagtattattctaaataatatatgcgtcggtgtcccttttcatgtacctgagtctttaattgtgtctgatttaatatctcacgatggtttgctccataaaattaatttcaaccgcagcaatcggcagccaatatccgacaagtgttccatcattcaatggatatacttctattgaataatttgaaaaaacagctccttttaatgctgggacttcaaatatttccattgatgtcatcaacttttgtaaagtcttctgtttcacagcaaatataaaaatagtatactctattatttgtatcttttttacccgggaaattcccataatcgccttatccatttcctttggaacagaaagattctttagcaaaccgactaaaccgcttttatataacatatcccaaaatccaaaatctgccgatgtaatcggggttgtgtaaagcctttgcagtaacacactttctctatcctttgaaatgaggacagcggcaaccaaggtcataaaggacagtccaaacaccgttataccaggtgtcaggtgggcaagcttgaacattggcacaggtatattagcttgaattgcagtaaacaagccggtaagaacaagcggaaaactcaagccgaagcacatgttaagaggatcacgcaatatttctttcgctgttctgctggaaagggaattcagatgcttttttattactgactcctgtcatcttccccttctcgtttttaaatccggtcaagatttccgctcacttcgataggaattcggggttttcccggtctcctccttaaacagacggttaaaatgggggatatcgtcaaagccaacttcctggcagatttcccggatcttcatatccgttttctgcaacagcttttttgctttttccagccgcagctttctcaaatattcggtgaaatttcttcctgtgtattgactgaataccgaagaaaacatggtataattcatgttgacatggtttgacacttccaccatatcgatatgtcttccataattcttttcaacatagtcaaccgcattttccattttctttcggtttacatatgacagtttttctatttcctctctgctctctgcatcatcttccgaccatgtgttccgttctttgagcgtctgttccgcctgccagagggcatccgaaagctctttccggtctatgggctttagcagataattgaccgctccggcccggaacatacttctggcatattcaaaatcgttgtagccgctgaccgctatgatcaatggcatccgctccttctccagatactcctgcatccaggaaaccaggcctagcccatccatgaagggcatacggatatccgtaagaaccagatccgccgggcttttctccagcaaagaagccgcttctttcccatttttgcactccacgatttcccggtatggaacgccgcttctttcgatcatgacacggatcccgtaacgggtcattttttcatcttcaacaatcagtattcttctcactgtccgatcccccctctttcagcaggagaatggtcttggtatagcagcccgctctggagtatatctgcacaccgcaacctcctccgtatatcaggcgcagccgcctgtgaatgttgtacagaccgatctgtcccgctccttcttcaccgcccccatcttctatttttgctcgaaccgctttcagtttttcttcgtccatcccctttcccatatccgtcatttcaatttttatttttccttcttccctgctcagctttaaatagatggttgtatccattttaattccatacagtccgtgaacaatggagttctccgcaagaggctgcaggatcattttgggaaccatactctttttcagcgactcatcctccatctggacgtacaccttaatctcataatccattctcagattcatcagcctgatgtagctttccagataggcaatctcctcttccagctccacatttttcgtatgtgtagaaagattatagcgaaacatcctacccagcgccagcagcgcgtccgccacatcaaagatctcccttatttccgccatcatcttgatggagtccaggacattgtatagaaaatgggaatcgatctgcttttccagcgctttcagctgcacatccttcagaatggtttcccgttcaatgctctcctgcgtcattttttccagattatccagcatcttattgtattcttccgcaatggttctgctttccacctgcttcaggcgcgggatacggagctccagttctcctgtggaaacacttttcacatattccacaaggatatccatatctgtcagcatccgttttacaatccgattgatggaccacagcaaaaccctgatgatacaatagaaaataccaataaccgcaagtatttccaacagtatggacagatactgcttcatcacaggctgacatcttaccataaatatgccgtttccggaatgtctgattagagacagcataattagccttccattcagccaaaggtaactggtctcgatcccatccgacagatattcttctatagaatcaacaccagtgatccgcgcaagcacttccagggtgacctctttgttgtcttccctgtcgacgccatactgttttccgccgctgtcgatcaggattcgatcctctggttcggcttcgtcatcgataccaggcgcaagcgcactgatcggaaccatcacttccaggatccccctgatatctgctgtcagcttaaagggcaggataaaggaagccatattatttccggttacatatccggaatagacttcctctttcgtactgccggatacgtcaaaaaaccattttccgctcacactgaccctgttcctctctgaataccacaggctgttttccgccctgtccatccgatagagataaggaggatattcccgccgcaggggatattcgatgtgcattcttgcagcccgaaccccattgatgctcatggcccgctgcaggacgggcagcgtctgagatctgaacagaatcctttcatattcactcacattattatccgtaaccacacgggtaacctcggcaaagaaccggctgtctgaggcaatcagcctggcctcctgctcaatgtctgccagagtggcaacaaaatcgtcaaaatcctgcatcaggctgctgtcagcctcccgttccagttcctcctttttctgaacaaacaaagcaggtaaaagaatcagaagaagcaccacggttggcagcagggaaaaaaacataaccgccctgcggattttctggtaaagcgtatcattttcaaaatttttcagggacaagaatctcatttccgttcctctttcataaatccagactttcgcgctgtaatcccgttctacccttccgtaatcggacagaatacatcctccagcatgtattctgtgatatgaacagattatatcttacggatacgccttttacaatcccctgcaaacccacccctggccgcgctgagcatggctacttttttcaaatagcagctatcttacccctgtctctcatagctgtttaccagaagctcatacatctcttctatcgtcgcaatccttggattgttgaggtaatcccccagaacctgtccgcaatccgcaatttcccggatatcctccatgctcacgtccagctccttatagccgatccacaggccgatacattttaaaaatccatcgatctcttcacagcactgctcggccgcatacgcattgtccctatcgcagagctctggattgaaaattctccccaccgcggcaaatttctccacagccgccggataagtatatctggtaaataccggataaaaggctgccagcgcctgaccatgagatacctgcgggcaatgacctcctacctgcattcccagcccatgaggcagagtgacaccggcgttggaattcgtcattcctcccagtgtgtccgcccaagccatctgcgaacgcgcctccatgtcgtttccattcttcagcgcctttgggagattttcaacaataatacgaattgcctccagcgccaacttttctaccataggactggtatttacagaaatatatgcttcaaaattgtggcagaaagcatcaaagccggtttgagctgttatctgcttcggcatcgatgccgtcaaatccggatctacgatcgccaccttggggaagatatttctgtgccagatggcggatttatctttggaagacgtgtgggtgataacactgcactgtgttacctgtgagcctgttccggcagttgttccgacagcgatgatgggcagtgtcttttctgtcggcccctgtgtatggcagttatagtcccataccgttccttcatttgtcgcttccactgcaattgcctttgccgtatccacacaggatcctcctcccagaccgaccactacctggactccgtgcttttttgcaatagctgccccttctgtcacgatgtctgtagtcggatttggtttcactccattaaaatgggctgtatcaatgcccgcttcctgtaaaaaacgcagcgctttttctgcgatcacctccgtggatttgctgctgcctgtcaccaggagagcccttttcccataccgttttgtcacatttccgatctctgccactttcccgcatccaaaaaggatttcagtcggcgcataataggtaaattctttcattttgtaaccctctctttccttctggtagtgtcaagtctgacactccgtttttattaaaaaccttgtattttcagggattataccgctttttgaaaataaaaaagcaatgacctcccctttttggtataatgtagtcaccacaaccaacataacctaaggatggatcattgctatggataacattatactctatttacttactataattcaagaacaatataatactatctgctgcctcctgaatctcatctgcagatattttcccctcagacagtgggccttcgatgattcccactcccctaagtaccagaagttcaccaccgaccgcctccctctcatcaaaccgttcatcaaacaggattggcaattccttctggagtactatctctggaaatacggcaaaccggtcacacccgttcagcgccgcaatggaaaatccatcccggaagatgtcttctgtccgctttgtggggcacctcaccactacctctacgacaacaatggcggcaacggacagtaccaatgcaaaatctgtggacagacctttgtcaccggcgatgttgtcacctcgcctcttcgctttgcatgcccttactgcggccactccctcgtccccaagaaagaccggaagttcttccgcatccataaatgcgtcaaccccaggtgttccttctaccttcataacctctccaaggttgacaagaacctcctggaggaggattacgacaaaaacaagtataagctgcactacctttaccgggaattcacggtggatttcttccgcatggacttagactccctgcctaagaattcctcctccctgaagttttccaaacataacgcacacatcatgtccctgtgccttaccatgcatgtgaacctccagctttccctccgtaaaacggcacaggctctttatgacctttacggaatcaggatatcacaccagcaggtcgccaattatgccagaactgccgccattgtcattaagccctttgttgaccactacgaatatccaaagtcctccatctttacggcagatgagacttatatcaaggtccggggcatcaaaggctacctctggttcatcatggatgccgcttcccgttccatcctcggctaccaggtttcagacaaccgctccgtcgggccgtgcatccttgccatgcgcatggctttccggggcatgaaaaggctgcccgaaaagttccggtttattgccgacggatatagtgcctatcccctggccgcccagcagttcgcacgggagctgggggacagcttcaagttcgacatcacccaggtaattgggctcacaaacgatgacgcggtctctaaggagttccgcccctacaagcagatgattgaacggcttaaccgcacatttaaatccacttaccgggtcagctgcggttacgacaattataatggcgccaactataacgtggcactctgggtcgcttactacaacttcctccgtccccataagcacaaccactaccgggtgctcaatccggtcgatatgctggagggtgctgacaacatgcctgggaagtggcagctcctgatcctgctcggccagcagaccattctccatttacaggagcaacaggaagccggcagcatctgttcttagattccgggccggaggtaaaaacgcagccatcccgaagggacctgcccttgatggcacgccaaaacaatgctatcatgctgtgacgcagacggtgaaatcttatctgttcttgagttcttcgccgtcggtaagacgttcagagcattgttttggtgtgccgtcaagggtggcggacactgccagtgtctaaatatatctgcaattttcaaggttcatttatgccgggttccccggctatcggttttcataaatcccttgacactaccttccttctcgccacggactcataatctaagcgaagcttatagtgagctcattaccttcatacctcacccactgttcccggtcacccaggcagatccgcagctgtctccccaggattccctgtgggaacgctttcctggtctccccgatcgtcaacctgtctgcaaaatcatcccagcgaagttcgacaaactggaattcaccattttcgtagccatacccatccccgccgtcttcataatggaaacagactgaatcgtttccaggatagatatgaatctccattggttctcctgtctgctgtccggcatacatcagatccttttccagaataaggatcgatccggcccgtacgaacagagggatcttatccaattccgcttccaccatcacggtgcttccgcccgcatatttttcatcggtatagaaatcgtaccagtccgttcccataggaagatagcattcccagcccttgctgcgctgcagcctacggttccccttttcaaaatacatgggctccgtcaccgggcataccaaaatactttctccgaacatgtactccgtctctgtgttttttgcgcgcatatcctccgggaaatcaaacagcaggctacgcatcatcgtataatcctggcagtacacttttcctgccatggagtaaatatagggcatcagccggtaccgtagctgaatcgtctttgctattgcttcgtaaaaaggttctccctcttccccaaaattccagatttcacgaggggtatccgtcccatgggaacggaataccggtacaaacgcggcatactccagccagcgtacatacagttcccggtaggccatatccccgatgccgtcttcatagtctccccgccagtaccaccacatgtcagatatcttatcagcgaaggcgccccgcttccaccaatgctcctttaccacaaagaacgctcccgcatccagcgtccaatagggaataccgctcatgcacatattcagtccttccctaatctgccttcttagtgtttcccatgtcgcgctgatatcaccggaccacagcaccgcgccatatttctgggaacccgcatatccggagcgtgtcaggttaaacacccgcttttcttcactttctttcctctgattttcaaagattccctgggcatgcgccaacgcatacagatttgcccgttctgctttcaggtattttttgtgttcttctcctaccagccgatatcgctcccatggctccctctgatacttcccgttccaatccgctccagaaaaaggttccgtagaatcacaccaccagccatctactcccgccgtgtagagctccctcttcacttgattccagtaggtttcccgggcttgtggagaaaacgcgtcataagtagaaaaatcgttcagcagctcacctttctccaggaattcccgattatcatccgtcccaatcccggaatttggccagatagaaaatatcacgtggacattcagcttatggatctcatccacagccttcctaaaatcaggatacctctttttgtccagttttttttgcccccacgcgccctcttcccaggtgtgccaatcctggacaatcccatcaaggggaatgtttcttctgcgatattcagatactacatcgatcagctcctgctgggtatcgtacgcctcctttgactgtatatacccatatgcccatctgggcaacatggcagccttccctgtcaggctgcgaaatcccgaaataatctcatccagattttcccctgcaataaagtaataatccaggcgggttaccgcatccaaaagaagatagcttccccgtgagtcatcgttccataccatcagcgaaccgcagtccgccaggattccatacccctgattcgacagaaagaatggtatcggtgtccgcatgttatgctggtaaaggtactgcgtatttttccgataattatagattccctcttccccctgccccaggccatggatatcttcctgagccttcaggcggaaacacagctttcccaaatatccattatgttccgataccggtatcagattttccgtgaagctgcgatcgccatctaccgtatgcaccagcctgctttccgcctgaccgtccacaatggtataatccggaatccgagtctcctgcagttccttagggccctcctccagcaggattcttccttttctgtccctccatcggaatgccacggtttctttatccaccgtgagccgcagccgaccggaggaaagctccagcgcattatcccgatcctgaacctgtatggctcccctgcagcgaggcctgatcccaaggggagatttttccccgcacgcaccttccttcgtgtaaacacatcggatgatatttttttccaccgcccagaagaacagctgcccctcgtcaaggtctgcccggatactgtcatgctccttctgaaatcctcttactctcataaagcattctccctttgctcctgcttgtaagcagaaatatgctgcatcattctacatagagtctaaataccaccgggtcttcactcttaataccgcatttgatatgaagcgcttcctcatcccggctccacttaagcgcctcccccgtctccaacagttccaccttatggatgatcccgtggaaattcgcctgcttcgaagcatccttttctcccagggaaacgatatcgtattccccgctgtcactgcatttcagggcggtggcatacacacagcttcccgctgtcgtgaagcggaagtctctgctggtaaaatttttcttgattccatcggaaaactgtccgtcttcgacttttgtaggtccttctccgtattttctccaggccttggttccataaacagcttcgccgttctttttcagccattccccgatatgaagcaggatattcctgtcctcttcggtaatggaaccatcggctttcggtccgatattcagaagcaggcagccgtttttactgacaatatctatcagatcacgtagaatatccggtgctgggcgaaactggttatttgcggtatagcaccaggaattcagcgccactgcggtgtccgtctgccagaaataatgtttgatttccgcaaactgccctctctccacatccggtacggctgtgccgaacaaaaatgaatcatgcttatagttaatagcgacttccactccccattctaccgcccggttatagtaataagccgccagcttcttcagccacggcttacaggcgctgtgctggatccaccagtcaaaccagacgatcttcgggcggtatctgtcaatcagttcacaggtacgcaccagccagtcctgcatgaattcctccgatggttccggcttacagtagatgtcctgcggatctccccccggcatcgcgggccagtagaaatcaccccgttccatgggatctctgacatcgctgtcgaattcttttcctttccccatgaagaaccagtgctcaatacggtggcttgacgcgccgagctgaatcccgcgcctttgacagcttgcactgatctctcccagcacgtccctcttcggccccatttcgaaggcattccagtgtgatatctcacttcggtacatctgaaatccgtcatggaactccgcaaccggaaccacatatctggctcctgctttctgaaacagatctgcccattgctccgagtcaaaatgctctcccttaaacataggaatgaaatccttgtagccaaaatctttctgctgaccataagttttaatatgatgctcatattccggagagtcctggatatacatattcctgggataccattcgtttccaaaagcaggaacgctgaagataccccaatgtacaaaaataccaaatttggcgtttcgataccaatccggcaccttataagcagataatgactcccatgtatccttaaaggggcctctggaaatcacttcatcaatcgttctaagatatgtctttaaatcgtacataatcataaccataccggccgctgcgctccctgtacttgtggagaagaaagataactgacaaacggccgcctttccaataaaatcaaattttgttttgttcacccttttatcgcgccgatcatcacacctttttcaaaatatttctggataaagggataaatacacagaagaggcagggtggacacaatgatggccccaaacttaatctgatccgcatacgtctgggcgtagctgcctcctcccgtattggacccgattcccgctccgttggcaaaggcctgattcctgagcaggatatcccgcaggataagctgaagcggcttcattccttcttcattgatatacattaatgcggaaaaataatcgttccagtgacccacgaaataatatagaaacaggacggagataaccgcctttgacaagggcagcgccaccatgtaaaagtacttgaaatgggaacagccgtccagctgcgacgcctcatacagttctgcgggaaggttttccacaaagcttctggctatgataacgttgtaaacgctcacggcagtgggaatcatcatcacccagatcgtattcataatatggagtttctgcatcagcaggtagcttgggataagcccacccgaaaaatacatggtaaagacaaacagtgccatcagcggcctccgcagccggaactcccttctggacagcgtataagccagaggcatagtaactgtaagattgatcgcagtgccaagcacagaatagaggatcgtgttccggtagccgatccagattctggaatccttcagtatttgcccataaccataagtactgaatcccttaatcctgaaaataacctgcccctggttaaccatggtagaactcgaaaaagaagcaatcaccacgaaatacaacggataggccactacaataaaggaaaagagacagataaatcctaaaacgagcttaaaagtaaaattcgataaacttaatttctttctcattgtgttcctcccatgattacatcaaactgatatctgctttctttttggcaattgtattaacaataatcaggcaggcaaaatttatcacattgttgaataaccccaccgctgtactgaaactgatctggtttgactgcacaccgatcttatatacgtatgtctgtataacctcagacgcccccaagttcaggggattctgcatcagatacgtcttttcaaagccgactgaaagaatccctcccatactcaggatcagaataataataatcgtcggaaccagcgccggaagctccacatgacgtatcatctgccatctgctcgccccgtccacctttgccgcatcgtataattcagtattcacattggaaagcgcggcgataaaaataatactgttccagccgcaagactgccatacgccggaaaatacgtagagcggaacaaaagccccagcatcgcccattacgttcatatcctccccgattacatgcaggtctttcagcaggtttgttacgacgccgctgggagcgcacataatattgagcatagcaaccataaccacagtagaaataaaatagggcatatacactgtggtctgcagtatttttctgggtgctcccttttttaactgattgatcgccaaagcaagtatgataggcatggggaaccccactacgatggaaaacagcgcaataacgaatgtgttgcgtatggtggtgaaaaacatgggactggtaaaatattgcataaaatatttcattccagcccagtctccgcctgttaatccttttgtaaaatcatagtccttaaacgccagttggatgccatacatgggagtatagcaaaaaacaatcacccatatcagcccaggcagcgccatcaccagcagctgccaatcccgatgccattccttttttattctcttcatgcctgtcgctttcactcctatcacacctttctgctgtaagctgtctgttcagacaggaaaaggcgccattcctcatcggcatctgtggcgccttttcatttacagattaatttccgattgcctcaagatacgtatcaaaggccttctgcataatatccagcgactgctgtatgcctgcgttttcaaggcttgccacataagcatcccattccgcctcgatatcattcgttccggtgatccagtttgcgacctgcggatcccagatatttctcaggttcgttgcattcatcgacagagtgttctgatcctcctgcgtatacttcatcagattgctcttaaaaaggctgtccgcagggatgttctcctgataaggcagataggtcgccttttcgcccagcgtcagatccggaactacggtattcaccttaacgtcacttctcacccacatgccgccattgtttacaaaggtgttcgtccactgccaggagctgggatccatggaggaatcctgcgggggcagtacctcataggtgccatcgttatttttcacgatacagttatctacatcattcatgccgccgtacattacttccaggctcacgtcataatcatagaactcattgataaacctcatgaccgcttccttgttctcacagtgtgcgctcatgctgactacattctttccccagaaagtgtcttcactcacataatagagctgatcatccggcaggctggcatccgctttcagcggcggcaccacaacatactgatccgccagttcgtttccaaagcgatctgtcagattccagccaaaggtaaagccaatcttggccgtcgtcccctcgcctcttccaagcgactggaactgagaataatcgttagtgaacgcagcttcattgatcagtcccccgttccaaagcttctgcatataagccaggaatgtcttgaaccgctcatccgtataccagcatttcacctgaccatcctccgcgaagaaaccatcggtgtacccgtttgacagaggaatgccaagtccgccgagcatgttcgccggaccatattgattgttcgtgttgatattccagataaagtccatcgggatttcatcatttgggtctccattgccgtttgcatcctgctccttaaaagcgatcagcacctgctccagttcatcccaggtagtggggacgtccatccccacattgtcaagccaggttttgttgataaacatggaagcgtagttcttgcaagcctcgtaggtaccgtcaattcttggaagattataaatctttccctccatatccatacacgcatattcgatatccggataggtttcgaacatttctttcacattaggagcgtactgctcaatcagtgaggccatatcttcaaacagaccgggatattggacaaaatccgcctctccagctgctgagaaaagcacatccggaatatccccgcttgcgaaaatcgcattcttcttgtcgttccagtcggaagactgctgctgccactccacttcaacattaactgcatccaccacgtttttcagccactgcatctcgtttacatccttggtaagaggagaccactttacaatcattgccgtcagcttcggcttctctccatccatgtccgcagcgctttccaccgtatcctcctcaccagtgcttaccaatgcgggctctccactggtatccgccgttgaagctgcattgtttccgcagcctgccagtgcgcttacgctcatcaacaacgccaaagtcatagccactaatttctttttcatacaaaacctccttttattcttcgtgttctttcaccatacacccttgtacacttctttacaaagtacacctcaatcccaccatctcctttcgaatctgcctgttaacgcagcaatacggcatatgaattactgttctctcgaaacatttccctttaaatggatgacagattttaaacacttgtttttgagatatcatatatttataatagcagacactacgcaagaaaaaagaagccatatttcataaaacttgtcgttttttcactgcatctgtttccttccgcgttacagtccaaaggactgctgcctcacttctaaaagttattgtatacatgctttaatctgtaaaagccaatgtaaaataatcggcgaaataaatacaaaaaaataagggacaaaccctgaacccctgcatttgcaagtattctttgtttagcccttattttacactattgtcaatacaggccatcaggaaagagggcagtattttaaaacagaagccttcttctccttatcacccggcccgtcaagcaggcgtgccaactcttccatccattcccggcacaggtaaggaatgtaaaaattttttatcataatccctgtaatctgtgatgccttctttttccatcttttccctgaacagggaaaacgcagcacctaaatatgccttttttcaccttagccgcctcttcctctttaaacatagcccatcccttgaggcgatccagacatgggcgacttacaatatccaacggaagaaccatcataccggaacatcaagttctccgctttcgatccatcactttcacaaagattattgcaaccaatgtggaggtcagtgtagcaataatacccggcacaataaccgccgtcggatttacgctcccgtactggctgcggtacgcaataatggataccggtatcagctgcagggaagatatgttcataatcaaaaaagtacacatttcattgctcgctgtgacaggcggcttccccgttcttctgcactcctcttcattcagcttctgcagctcttccatggctttcagcccggccggagtgcaggcccagcccagccccaggatattggcgataatattggtggaaatatattccctcgccgcatggttccccggaatacggggaaaaagaaaggagataaagggctggatccctttagtcatcgatgctatcagaccggaattctttgcaatctccatcagccctacccaaagagccattattcccgtcatggtaatacacagttgtaccgcctcgcccgcactgtccagcgccccattggccaccgcctcaatattgcctgtaagagcgccataaataacccctatggcaatcataactgcccagatataattcagcataaaaaatcctttttcttccattatattttttatttttctgagaaagaactctttatgccaaatccttatccggctgaatcatcttgtcagccactctaatacattcatttgcttaataccattatgagaggttaatggcgtatagtccattgtcaataaatacttgggattatgatcttttacagcctccagcgaagaaagctctctcttcagtgtctgttcctccataacagtctgtgaaacctggtagtattcctcaccttcactgtttatggcaatgaagtcaacttcctgtgcgctgacttttcctatatacacttcatatccccttcggataagctcaagatacacaatattttcaaggatatgaccctgatccgcctgccttgttcctaaaaggaagtacctgagcccgatatccgcggcatagtactttgctcctgtcgccagatactgtttccccttcacgtcatatcttgatgccctgtaaaaaatataactgtcggtaagagccgacaaatagctttccactgtaggaacacttatttttcgtcctgccgatgtcatggcattagcaatttttgtgccggaacatagatttccgatattatcaaacataaattctattatactttccagcatagaaggatctgaaattttttttctggtaacgatatccttaaccagaatagtattataaatcccttcaagataagcgcgtatatcctgcttccttacaagctcaagtgtaccgggaaaagagctgttggacaaataattcatataaagctgggctgtattatgattttccggaaaagccgatacatattccttaaaggagaggggcagcatttttatctccacatacctccctgacaacagggttgccagttccccggacagcagatatgcatttgaaccggtgatatataaatccacatttttctttacatacagccagtcaaccgcttcctgaaaattttctgcctgctgagcctcatcgagaaaaacataattcatggtattctctgttaatctttcggcaacataagtatataaggtttcagcagtccgtatattcctataatccccatcctccagatttacagagataatctgttccctgcttacgccgctttgcagtaaataatcctgatacagttcaaacaaggtagactttccgcatcttcgtatccctgtgataaccttaattatatttttatcttttagctgaatcaaatcttccagatattctttccgattaatcatggcctcacctcacaattatatattctaaaacaatcttaacatatattaccaaaaagtaaatattgtaaagtttattttacaaattaataaattttatattttttaataaatatattttacacctattttattccaacaactgaaaattatacagaactattacgtatcttcacagtcacaaatataaaaccttcaaatactttatacaatttacctcttaaccaattcacaaaaactgcctcaaatgatatggctatggctcattgcccatggatataaaaaagcccacaggaggaaacgttctgtaaccgttttctcccgcaggccatctgtctttatctataagccaatttccatccgtcttttacagcaccttagaaaggaattcccgcagtctcggattcttcggattatcgaagaattcccggggagcgctctcctctttaatcattccgtcatccataaagagcaccctgcttcccacttccttggcaaatcccatttcatgggtaacaatcaccatcgtcattccatcccttgccaaatcggacataacccccagaacctctcctaccatttccggatccagcgcgctggtaggctcatcaaaaagcatcacatcgggatgcatacagagggaacgcacaatggctatacgctgcttctgcccgccggaaagctgggaaggataggcatttgccttttccggcagccccactctttccagaagcttcatggcttcctcttccgcttctttcttcgatctcttcagaagctgtacaggggccagcgtcatgttctgcagaatggttttgtgaggaaaaagattaaaatgctggaacaccatgccgatatgctgcctgtacaggttaatattggctttcggatccgtgatatcctttccttcaaaaagaatctgtccgccggtaggctcctccagcaggttgagggaacggaggaaggtggacttcccggagccggaaggccctactataaccactacctctccctgggatatggtagtattgatatttttaaggacttcaatatccccgaaggatttgcaaagatccctgatttcaaataaaagttgtccatcagcgttcattagtccgtaacctcctttccaatgcggaaacacctgctgccagcagggaaacaatcgccaggtaaaccaatgctacggcaagcagaggcataaatgcggaataggtctggctgcggatgacattgccgccatgagtcagatccgtcagagcaatataaccactgattgatgtttccttcagcagtacgatgatttcatttcccagcgcaggaagcacatttttaagagcctggggcaggataatatgccacatggtggcagcataaccgaagccaaggcttcttcccgcttcaaactggccgatatcaatagccataataccggaacggacgatttccgccacgtaagcaccggaattgattccgaatgccaggatagccactacacgcttatcaatcgacacgcttccgaagataacatagtacatgatcaaaagctggatcatggtaggcgtaccgcggataaccgttaaatataactggcatatgaaatccacaagcttaaacaggtaataccccagcagctttctgatatatacgcccttctctttcatccttaccggcttcttgattccgctttttacggcgctggaacggacaattgccacgagaaaaccaagcacaatacccagaatcaccgcaaaaaaggtaatcagcagcgtcgtcttcaggccgtcggtcagatatttccaccggttgtccttaatgaagttcagataaaactgatccataaatttctgcatgtaaacaccctccaccatttctcctttgtctttttgtacatcagccaggcactgtcaggctgtctgataatgtctggctgatgcgcaacaaacgggcccatggtatttcatgggtccgcctgtatataacgcattctgtttcctaaatacagcttacgttccgtctttttccgaagccgtgctccgtaattgtcactcttttacaatgataacctgcttggaggaagcataggagtctgtgaaatcaacactctgctgacgatcctccgtaacggtgatgccggcaacaccgatgtctgccttaccggactggatagcattgataatggaatcaaattccatatcttcaattttcagttcatatccgagcacatcacatacggcctgagccatatctgcatcaatacctactaccttgtcaccctgataatattcataaggctcaaaataagcattggtcgccataaccagcgttccgttggaacgatccacatccgcgggagattcatagggagactgaccttttgtatcatccccgatataattcttaatgatattatccagagttccatcagactttaactgagcaagcgcttcgttaatctttgctgtaagatctgctttatctttggaaacacagatagcataatcttcttccgcaaaaggctcgtccaggattttcagccctgtggtatttgcaacaaaagcctttgccggctgttcgtcaatgatcacacagtcaatttttccctgaagaagtgcctgaaccgcatcatttcctttgttgaaacgctcgatggtggaaccttcttcttcataatcggatgcataaatatctccggtggttccaagctgaacaccgattttctttccgggaaggtcatcgatactggttaccgcgccttctgccgcaggttcctgtgcttctgtggattctgccgccggtgtggtttccgccgccgcttccgtacctgcctctgaagatactgctgccgaagactccgcagccggttcatttccctgtgcggagcttccgcaggccgcaagagaaattgtcatacatacagcaagtgctgttgccaaaaactttttcataataatcctccttgttttgcggagaaaaaagcaatttctttagaaatttgccctctgacgaacagaggattttcctccttatatcaaagtgcgaatcaccctgatatgctgttcttaataattagattgtataattatacattaattacaattaatattaacatatttattttgaaacacaagcggtatttttcacaaaataaaaagagatgaggaaccggtttttttcacttttgctttaatccatcttttttggcatatataaaaacagaagagggcgaaaatccgtgatttccgcccccttcatccatattttcacttatgcagtctcatcgcccgcgggaataaatatgctaccactccatcactgccgttccccaggaaagcccggcgccaaaaccgcagagtacaattttatcccctttttccagatatcccttccgattgcactcatccagaagaatcggcacgcttccggcggatatatttccacaatggtccaggcttacgggaaacttatccacagaaatatgcagtctcttggcaacagactgaagaatacgcagattcgcctggtgcaggaaaaagtatttgatatcctcggcctgcagccctgccttctcaagagccttgcctatcgaagccggaactgttttcaccgcgaatttgtatacctcctgcccgtccatatgcacataatccaaatcggtatctgactgcaccagaaggttgttattccccctgttccggcatatcagggcatctcccttactgccgtcacagccatgatcgaagctgaggatccccacatcctccctccgtaccacggccgccccggctccgtccccgaacaggacgcaggtgcttctgtccgtccagtccataatccgggacaatgtttccgcccccagcacaaggacattccggaagcgtccggttccgagaaaagcatctgcgctctccagggcaaacaaaaatcccgagcaggccgcattgatatcaaaagccatggcgtttcctgctcccaggcgggcctgaagctcacaggccgcggacggagtcacatgatccgcagtaatggtacctaccagtatcaaatccagatcctccggagcaattcccgcgtcctccagagccagcctggctgcctgttctgccatatccgtggtggtttcttcccttgcgatccgtctttcccgtatccctgtacggctgacaatccattcatccgaagtatccatcttagtggacagccagtcatttgttaccttcgccgccggaagacagcttccggtacctataattctgctcttcatatattcctccagctctccggggacgtgtgacacacatccgttataaatgtccgtccagcgcgttcccaatctattttaaagcatccgcaacctcgcccaggatatcttccaccttttcgattttatccgatcggcaggcattgcttccgcagaaaagaagcccgttctccacatccccttccacagcgcgaatcagcgcctccgtaatacagtaaggggtatctgcgggcttacaggtcttaatacatccaaaacatcttccatggggaatcggccccttttcagccctttccagaaaagcattccggatagcgcgccccggcattcccaccgggctttttaccagaacaatatcctcttcccctgcatcgatataggtttgcttgaatgcaggatgggcatcgcactcctccgtggtcacgaaacgggtggccatctgtactccctgcagtccgcgtgaaatccagtatgcggcctcttctcccgtataaatgccgccggccataaccacaggtatctcttttccctgttccgccccatatgccttgacggctttcagaatccgttccacctcttcctcatagtgcatacccggaatatcctgaagctgttcccttgtaaaacccagatgccctccggcaagaggtccctctatcaccaccatatcaggcaggtaatcatattttttcatccagtatttaaaaatcacattggctgatttcaggctggatacgataggcgccagcttaacagaatgacttctgccctgagaggatgcgcctgccgcgatatccggcagcgttaccggcagtccggcgccggatatgatcaaatcagcaccggcctcaatggcagttctcacataatcctcatagttctgggtagctaccatgatattcacgccgacgattccgccctgcgccagctctttcgccctgatgatttcctgtctgactgcccgcagattggcctcatgggggtttttatgataatccggttcccggaaaccgatttgggccgtggaaataattccgattccgccctgcgccgccactgctcccgccagtccggaaagactgacaccgacgcccatccctccctgtatcacaggaatcctggccgtcagttccccgattgttaaaggttttacactcatttttatctcccggtcccccttttcaggctttctccggttcgctgacaacaaaagtcagttccgccttggctaccagcttcccgtttacggtcgctttcgcactgcctatccctatcgggcccttaactttgatgatttgcgtttccagtaagagcacatcccccggaaccactttccccttgaaacgggctccgtcaatccctccgaaaagcaccagttttcccttgttttccggctggctgagaatggcaactgctccggcctgcgccagcgcttccaggataaggactcccggcatcaccggttcctgaggaaaatgaccggcaaaaaaaggctcattataggtcacacatttttttcctaccgcacgtactcccggttccagctcctcgatggtatcaagaagcagaaagggctgtctgtgagggatgatttccataatctgtttggttgaaagctgcataaggcattcctcctaatccacgaatttctttaccagaagactggcgttgtggcctccgaagcccagggaattggaaagtgcatacagcacctcttcttccgcaggttctttacaataatccaggtcacattcctcatccggtatctgatatcctactgtagcatgaatgtagccttcctgcaattctttcacacaggtgatgaattcaacggcccccgctgctcccagcagatgccccaccatggatttcgtggaattgatttttatatttttcgcatgttccccgaaggtcagcttaatcgctctcgtttcgaacaaatcattgagatgggtactggtaccgtgagcattgatataagtgatatcttcaaaagccgcgcccccgtctttcaccgcgtattccatggccttggccgcaccggatccatcctccgccggagaggtgatatggaacgcatcggaagagcatccgtaacccactacctccgcatagattttagctcctctttttcttgcatgctccagctcttcaagcactacgacaccggcgccttctcccataataaaaccgcttctctccttatcaaaagggatggagcatctggcgggatcctcagaagagctcaatgcggtaagcgccgtgaagccggaaactccgataggacagatgctgctttccgcacctcctgccaccataacctccgcatctccatactgaatcgtacggaatgcctctccgatacaattggtaccggtggcgcaggccgtaaccacattaatgctttttcccttcaatccgaactgtatggaaacattaccggcagccatattgctgatcatcatgggcaccagaaaaggatttacccggttgggccctttttccagcagcttgccgtattccctttccatcgcctgcagggaaccgattccggagcctacggcaacgcctacgcgccagggatcctcattttccatatccagccctgcatcctccagcgcttccctggaagccgccactgcatactggcagaatgcctccattctcttagccgccttaaaatccatatagttcttggcatcgaagccttttacctctgctgccagcttacatttatattcagatgcatcgaatttggtaatagggccaaagccggtttttccttccttcacccctgcccagaattcctccaccgacaggccgatgggcgtaatcgctcccattcctgttactactactcttctgctcatatctgcctctcaatctgccgcacaaacggcctgtaaccacatccggaatggtcagatagccattccaccatcaaccgaaattacctgcccggtaatatacgctccgccgtctccggccagaaaagccaccagctcagccacatcctccggccggccttctcttttcaggggaatctgtgaaataatcccctgttttgcctcatcagacatcgccgcggtcatatccgttgcaatatagccgggagccaccgcattcacagtcacattcctgctggccagttcctttgccacactcttcgtcaggccgatgacgcctgccttgcttgccgcataattagcctgccccgcatttcccagcacaccggatacggaagacaggttaatgatcctgccgcccctcagtttcataaaattcctgtataaatggcggatggtattgaaggtaccctttaaattggtgtcaatcaccgcatcaaagtcctcttccttcattcccaccaccaggttatccttcgtaattcctgcattatttacaagaatatcaatatgtccgaaaagctccagcgctttcttaaccatatcgccgcaggcctggaaatccgccacggaacactgaagagcctccgctttcctgcccatatcccggatctgtgaaacagtctcttccgcccgttccctgctgccgttataatttacaataacatccgctccctgtgaagccagagtaagcgcaatctgtcttccgataccgcggctggccccggtcaccagggctgtttttccttccagcgtcatactcttactcccttccggacaggggaagcttctccagatcctctgccttttccacatttatcacagtcacatcccggtttattttgcgcataaaaccggaaagggattttccgggaccaatctccacaaaggtatcgacgccgtccgctatcatacgttccacacattcctgccatcttacggaactggagacctgttttacaagaagttcctttacctgtgatgtatccgcaacataatctcctgtcacattggaaagatagggaacgtggatttccttcaggctgatatcggcaagcacctgacccagcttctctccggcgcctttcagcataggggaatggaaaggcccgctgaccttcagcggtacacagcgcttggctcccagctccttcagtctctccgaagccgcattcaccgcaccggcttctcctgtgattaccgtctgtcccggacagttatagttcgccacgctgactatcccatccgtttcttcacaggctttcgctatggtttcactgtccagccccagaatcgcggtcatcgctccgccggtgggaacagcctcctgcatgaaaattcccctcttgcgcacgcaatagaacagatcctttacatccattacgtccgctgccgccagagccgcatattcccccagactaaggcctgccgccgcatccggccggtatcccatttcctccagcaccttcagcagcgccacctctacggtgagcatggcgatctgtgtatattctgtaatatgaatctgttcattttcctcaaagcacaaagctgccacgtccagcccggaagcttccgatgccttgtcaaaaatatccctggctgcaggaaatttttcataaaaatcttttcccatccccacatactgggaaccctgccccgggaaaataaatgctgttttacccattattttctctcctatgaaaagcgaaacgcagacttatccgtctccgcagtactgtctgttctgatcggttatgttaaatctcaatggtagtatggtagaagttatggtagttggtgtgtgaaaaacgataacggtatatattttgatatcctttttatttgatattcaaaatatatagctgtaaaaaaagactgccggaattccctgcctgcaaacgggcccgaaagtctttccctgctgattggcacaaagaagcctgttgacggaatttctcaaaatacccgaatatgtcagattttcagcaatgcactgccgtcatggataatctcttcgataatctcacggcagctctgaacgcggctgaccatacctgcacactgtccggccataagggttccgtttaccacgtctccctccatgacagcttttctcaaggctccaagagttaaatactccaattcctcgaaagaagcgccttccttttccagcttcagatattctctagtcattttattgcggatctgacgaatgggatgcccggtgctcataccggtaatttcggaatcgatatccctggctttgataaccttctgcttatagttatcatgggcaatggattcactggccgccacaaaacgtgtgcccatctgcaccgcctgtgcgcccagcataaatgccgcggcgaatcctctgccgtccgcaataccgccggctgcaataaccggaatattaacggcatccgccacctggggaacaagcgtcatagtggttgcggatcctatatgcccgccgctttccatgccttccgccaccactgcatccgctccggaacgttccatcattttagccatggcaacgctggcgactaccggaatgaccttcactcctgccgccttccacatatccatgtattttgccggacttccggcgccggtagtaactaccttcacgccttcttccacgatcacctctgccactccgtcagcattgggattcagaagcataacgttcaccccgatgggcctggacgtaagctttctcgcatcccgaacctgctgcctcacaatatccgccggtgcgctggcggctccgataattccaagcccgcctgcttcagagacggcagcggccagatggtattctccaacccaggccatgccgccctgtataatcggatattctattccgagaagttccgtgactgctgtcttcattaagcctcgatgccctgtgctttcagatattctacaactgaacctaccgttgtcagtttttccaattcctctgcaggaatttcaacaccatattcttcttctaccgccataaccaattcaaaaaggtccagtgagtcagctcccagatcatccttgaaagaggactcctctgttattgtcacaccttccagattcaactgctcctgaataatttcaattactttctctaacattttgttatctcctttttttgtttttataaaaaagtttgacattcaaagtatattctctgttcctttgtttgtcaactacttctttccacatttttgataaaatactgataaacatccctcttgctgattcccctgtccttcgccaccagcttcatggcctctttccggtcaatcccctgatcctcgtaggatttcatgtgctcttctatggacatcctggaaaaaatttcctctttttcctgctgcttttcagcccggctttttccctccagcacaagcacatattcccctctaggcgcctccgactcataataatgaagggcatcctccagggtggtcggcattaccgtctcgaatttctttgtcagctccctgcagagggttatcctccggttgccaagttcctcatacagacactccagcgtccggatcagatggtgaggagcctcatacaggattatggtcctggattcctcctttaattcctccagcacagcctttttttcttttttatcatcaaagggcagaaacccttcaaagcaaaacctcctggtgctcagtccggacagcgtgagcgccgtaatgcaggccgcaggccccggcagggaggtaacggtgattcccgcctcctggcacatttttacaagcacctccccgggatcggatatagccggtgttcccgcgtcggtaatcagtgcaatattttttcctgcctgcagcttatttatcaaatcatatgctttttctactttattgtattcatgatagctggtcatcggagtctgaattccaaaatgattcagaagcttaatgctgttgcgggtatcttcagccgcaatcagatctgccgtttccagcgtttcccgcacccggggcgtcatatccttcaggtttccgataggtgtggcacataaatatagaataccagccattgctttcctttccttcagctatccatttcttcaggaagcagccctccctccgtataacggttagaggcgttccacagaatccattcctcgtagccggcgtcataaaccgcctgtatctgcgcccgaatctcttcagggccataacggatatgcccttttacccatgtggcggtaaaatcctgcagccagggccgtacatccgcccggatttcctgattcggaacgagatccttaggatccgccgtatccatactcttaccggaaatactgttttctgaaatgccgttgcctgacatgctgttccctgaaacatcatttccggatatgtcattgcctgacagcgaactttctgtttggggcagtccgccggatatgtcatttccggatacctgcatatcttccgcttcccgtcccataccagccagtaccttccgggaagtcttcatgcttctgaatatggtttcatatggctgtgcatccggcaccgccagccccaaattccccggcccgtaatgggagggataaaccatagggcttatatagtccagatgcttcgccatttcgtaataattctgccctacaatggaagcatccagtttgctgtcaattataaccccgtatacatctgccgacaagggaactcccatatcatgcagctcctgtgccgcatagatcgtaaactccgttatgacatcctccttgtcctgctccagggcatcctctccgaaatccacctttgacattccggcatctgtcgaaaaccggatataatcaaactggatctcatcaaagccgacagaagccgcctgccgggcaatctccagaagataatcccagacctcccttttatagggattcacccaggcgagcccggatttatcccggaaaatattaccattcttgtcggtaagggccaaatcctgcctgttttccgccagaaaaggatccttaaaggccacaatcctggcaatcagataaattccgtgttccttacatttacgtatcagtcccggcatatcggaaacatactctttgacggctccgatttccctgacaaacgcggaatccatgtcatataccacacgtccttcgtcgttcttcacgtcgattaccatggtattcagttccgtcctgtccaccagatcgataagattatccatattggaggttccggccatagcgccggtaacataaatccccttcacccggactttttccgcaaaaggttccgttaccgtttcttcctgcgcttctgtttccccattcccggtttctgcttccgtgccctttacggtatcggaatcagtatccgtcccggcccggtcatccgtattttctgaaacagcattttccgaaaccgcctttccggcttcctcaagtaccgccgtttctttcgctgtgttgctgcatccggccagatacaggcttgttatgccgataatcagaatgcaaagcagtgcggccgcaactatacttttttttctcatcttccgtttctttccggcctgtgcaccgtaattatttcatctatctaatctaaaataataaccgatacttcgggaattttcaatacccatatatatcatatatttcatcggtatagataccgggttcccgatacacgatcagaggcctttccaccgtcatccggcttctccctccccgattcgcttccagcaggaccatattgggttccttgtccgcaaaagggtaaaccagacgcatccgtttgggctccagcttatacctggtcagggttaccataatctccgcaagacggaagggtctgtgcacaaggaaaaaattgccccccggcttcaggagccctgccgcctgtgccgccacatcctcaaaagtacacttgacctcatggcgcgcaatggccttgggcgcttccggattggtgagcccatgccctcccgccatataaggaggattacaggtcacgacgtcaaaagaagcagccggaaacaagcccgctgcttctctgatatctccctgtacaatatctattttctcttccagaccgtttaaggccacgctccgcctcgccatatcggcgctgtccgcctggatttccagccctgtcagatgggacgccccggtttttgcttccagcaggatggggatgatacccgttcccgtacccatatccagtactgttcccccgtcttttaccctggcaaagccggaaaggagcaccgcgtccattccaaagcagaagcgttccttatcctgtatgatcacatacccgtttcgctgcagctcgtccagcttttcaccaggcttcaattcgctgctacagtttggatttctcatcctgcttctccagtttttccaattccttcagttctttttcgctcacatcattcttcttattccggccgtgtctctttttaaaacgcagctgatccaggggatactccctgatttccttctcgtcatccacatttacaatgaccttcacctgctggcggagtacattcacacttgacacctcacccttgaggccgtcatccgttgtcacataatccccgatattaggaagcctcctgtttaaatcctcataggtttcctcctcatgcttcagacagcacatcagtctgccgcataccccggaaattttggtagggttcagagaaagattctgttcctttgccatttttatggaaaccggaacaaactcggacaaatgggtgtggcagcaaagacgcctgccgcagatgccgattcctcccaggatttttgtctcatccctcacgccgatctgccgcagctcaatccttgtcttgaacacactcgccagatcctttaccagctccctgaagtcaatccttccgtctgccgtaaaataaaacagaaccttgttattatcaaaggtatattccgcatcaatgagcttcatatccagtccgtgcttgcggatcttttcctggcagatacggaaagcttctttttccttccccttatttgccgcttcctgctcgttatcccgttccgtggctatccgcagcaccggctttaagggctgtaccaccttgctgtcgtccacttcccggatgccgcccactacggttccgtattccacgccccgggcagtttccacgatcacatggtcccccttctttatctcaaaacgggtggggtcaaaataataaattttccccgccgtacggaatctcacgcctataacttttgtcatctataaacctccctgagggatctagttttccttcatcgtaaggaataagagctccatcgttaaatcaaaattaacattggcagacagccttgacttggctttttccagggaatccaggataatctcgattccttcatagctcttctgatccgcttcttttctaatatactttatttcttccttaaaaatcaagtgatttgcatcattcgtagccttaaacagcagaacatcccggtaccagatggaaaggatatccagataatccgttacatccagcttgtactcgctgattttcttaatcgccgccactatttcagatatttccatatcatgaatatattttaaaagcgttaccgcttcttctttcacattatcgaaatcctcactggaagccagcagcttggcccgtccgatattccctcttgcaaaagccacacagacgttggccttataatccgggatctgcatgtcctccataagaaatttacgtacgatatcatccctgacaggcttcatattcagcaccacgcaccggcttacaatcgtgggaagcagcgcctccacgttcgtggtaaggatgagcagcaccccataggccggcggctcctccagcgtctttaaaagcgcattctgggcctgtacggtcattttctccccctcattgataatatatatcttataagggctggaatagggcttaatcgccatatcgttattcacctggctgcggatatcctccacaccgatgctgttgggcttctcatgggtcacccttatgatatccggctggttattgctgtccgcctgcttacaggaatggcactcgccgcaggcatccgtacctcccttttcacactgcagggttttggcaaaaatcctggcaatgaattcctttcctgagcttcgttccccattcataatatacgcatgggataccttgccggtctttattgcattctgcaaatgctccttcatcgcttcctgcccgtaaatatcctgaaatcccgccatatttcctcgctttcccctgtaccggcacggttaatcccgcgtctgcctgatatagtccttcacttcctcaagacacatctccaggctgttgttttggaaccgtttctcaatccccgcctccgctatcttctcttcactgaaatcttcacagtccgccaggaaccgcctgcacatctcttcgtatttcggcttttcctgttttctttcccgatccaacgccctctgcaggcgttccccgtcatccacttctatatacaggggcacgatgctgccgccccccacatatttccttatcgccaaaaaggattccagcgtccctatcatcagataatcccgcttcgtcaaatccagctgtccgtcatccacggtaaaataataccaggggccatgataggtatgataaacgcgttcttcaatcaccctgccgctttcacgcagcttctccagcccggcctcatcggtaaaaaaatattccctaccgtccatttccccggcccttatgggccgggtagtataaggaatcagcttattcagtcctaaactctcacattccagaaggctccggtaaatcgtatccttcccggaagaactctttcctgctaaaaaatatatttttcccatatttgtttaactgctgctgccagccgtcactcttcctcctcggtgcagtccgtagcgtaagctattgcacagtttacagcccgcttccagcccttcagttttttcttccgttcttcctgggacataaaaggaaggaaggttttctccaaaaaccagtttttccggatatcctccttatccttccagaagcccgtggcaattccggcaagataagcggctcccagcgccgtagtttctatgcactccggacgcagcacttctttattcataatatccgcctggaactgcatcagaaaatcgtttgcgcttgcgccgccgtcaacccgcagatttttcagcttaatgccagaatccttttccatggcttccagcacatcctgtgtctggtaagcaagagactccagcgtggcgcggataaaatgctctttcttcgcacccctgctcagcccaacaatcgtccctctcgcatacggattccaataaggcgctcccagcccggtaaaagcgggcaccacataaacaccgttggtgtcctccacctccatggcgtactcctgggactgcggcgcactttttatcatgcgcagttcatcccgcagccactgtatggccgctcctgccacgaatacactgccttccagcgcataacggatttccccctccgtactggccgcaatcgtggtcagaagcccgttatcggaggccacagccttatcccctgtgttcatcagaaggaaacagccggtcccatatgtattctttgcctctcccgcatcaaaacagcactgtccgaacagagccgcctgctgatctcccgccgcaccggcaatcgggatttccccgccgattaccgattcatccgtatagccgtaaatacagctggacggttttacctgaggaagcatggagcggggaatttccagcttattcaggatttcatcatcccagtcccttttatggatatcaaaaagcatcgtacgggatgcattggtataatccgttacaaatacttttcctttcgtaaggttccagataagccaggtatccaccgtaccaaaaagcaaatcaccggcctgtgccatctctctggcaccctccacattatccaggatccatttgatcttcgtcccggaaaaataggcatccggcaccagtccggtcttctcccggataaccttatcgaagccctcttccttcagcatttcaatcgtgtccgccgtccgtctgcactgccatactatggcgttatacaccggttttcctgtttttctgctgaagcagattgtcgtctccctctggtttgtaatacctatcgccgcgatttcgtcaatcgccgcgccgatttttcccatggcctccacagccacactcagctgtgaggaccagatttccagaggatcatgctccacccagcccggctttggataaatctgtgtgaattccctctgtaccacagatttcatatggcctgctttgtcaaaaagaatacagcgggaactggtagtcccctgatcaagagccatcacatattttttcatacgtacccccattccgcgtatatggatgcacgctttccttcaaaaggccgcggcatccttcccccataatatacgcaacaattttatcgtattataccataatttcgtgtgccgcaggcacacatggaatcagaagtgaatttattcacctttatacttcaaccacacgaagctggttggtttttccggatatacccagaggcatacctgcggtgataataattttatctccttttacaatataccctgcatccacagccgcgtcaattgccgcatggaacaaatcctccgcggtattttcttcctggatgagaagaggcatcacaccccactgcagattcagctgacgccatacaagacgcttcaccgtacatccgataatcgggcagctgggtttgaaacgggaaatcatgcttgccgtaaaaccggacatggtaacacagatgatcgccttcacatcaagatccgccgccagtgtacatgtggcatgggaaatcgcggtggttatgttgccgtccccgggaacctcacgcttcttcagacggccggcaaaatcaatatcctcttccgttctttccgcaatgcgggccatggtctgcacagcctccaccggatactgtccctgtgcgctttctccggaaagcatgatagcagtggttccgtcgtaaatagcattggcaatatccgtagtctccgctctggtagggcggggattatgcatcatggactccagcatctgtgtagccgtaataacctgttttcccttggcaacagccttcttgatgatctgcttctgaagcacgggaacctcttcgagaggaacctccacgcccatatcccctctggcaaccataataccatcggaaacctcgataatttcatccaggtttttaattccctgcatattttcaatcttagagataatcatcatcttggaattgcgctcatccagaatcttacgaacctccaggacatcctccttattccgtacaaaggatgcggcaataatatcgaagcccagctccacaccgaataaaatatcgtttttgtcagactcgctgatataaggcatggatagctccgcaccgggcacattaacccctttatggttggataccggtccgccgtttacaacattgcagatgatatccgtgtccgtaatttcctccacggtcatctcgatcaggccgtcgtcaatcaaaattgtggttcccgcactgatatcatggatcagttctttataggtaatggatgctatttcattcgtacccattatttcctttgttgtgagagtaaacttctgtcctgcttccagcattacctttccgccttcaaaatcacgcagacggatttccggtccctttgtatccaaaagcgcagcgatgggaagattcagttccttgctcaccttgcgcattctatcatatttaccatgctgctcttcatgatctccatgggaaaaattaaaacgggctacgttcattcctgccagcatgagttctctcggcttttcctcactttgggatgcgggtccgatcgtacagataattttggtttttctcatattaactccttccggtgtctgcacacctgtcatttaagtattgatatttgtaagtctccggtcaaccccttgctgtcacctgcgttctccaccccttgtacgttcagcctctgccttacgtacatctctattaacttaatgacctcctccgtaataacctctcccggaattaccagaggaattcccggcggataaaggttcacataagttcctgctgtctttcctgccgctttccgcaaagggcagaattccttcggcgccgtcaaagccctgtgaagcggcagcgccgttttcagttccggatatggcttaccggtcagagcctcttcccccggaagacactgtccttcccttccgtccgattctttttctgtctctctgtcaatctccagcaatgcttccgccagccttaacagaccttcctccctgtcccagggagtcactatggcagttacgtaagtatcggatgccatctccaattgaagataataccggttcagaagctctttgtaaagcgtatttccagtaattttcgtattaattacggatatcagcagttttcccgcatcaaaagctttcatacagcctttttccataatatccctgttcatcacccggatatgcttcaatccggccgttttttcataaaacagccgtaatttatccccgaatccatcccagcattcccctttttccaacaggcgcacacaggcgtcaatactgcccgtcagcagataggacggactgctggtctgatatatcctttcaaattcccttaccccttcacgatccaccagaggcccgctgacatgaagcagcgccgtctgggtcagcgccggcagcgttttatgaaggctctgcaccaccaaatccgctccctgacgaaccgggctttccgggaaaagagggctgaaaccgaaatgtgcgccgtgagccgcatccacaatcagaggaatcccggcccggtgcacgatatctgcaatcttttcaatatcggaaaccactccgtcataagtaggggatgtaatgataaccgccgctatgtcaggcacgtccttcaaagcctcttccacctgttccggccggatcgcatccgctatcccatattcccgcacagtccggggatacaggaataccggatgcagttcccgcaggaaacaggcatgatatactgatttatggcagttcctcgccacaataaccctgctgcccttcggcgccgccgcagaaaccgccgtaagaattccggccgtggaaccatttaccagaaaaaaggtctcatccgctccgaaaacagccgccgctctttcctgtgcctccagcagaatccccttcggcgcatgcaggtcatcaaacccttctatttccgtaatatccagctttgccgccccggccagccgggatatctcctccggcatattccgtttatgccccggcatatgaaaaggataaacctccgaagccgcatattcacttaactgctgaagtattccttccatttgcctcctgcccgctgttgttctcaggtgtctcactattcggccttaccgtaaccttccggggaatgacagcccaatgccgccccagatgcttcatctgctccagacgcggctccaccgtttccaaaaaagaacaatacttatccgccgccgtcacaatccaggcttccctgcacagaggcggcaccaatgtgagcggccacatatgctttttgatgatatcctgctctctgggcgaaagctgatattctttcctcgcattattcagcgctgtctccgggtgggtaaagccatgcagattcctccatccctttttatgaatatgattatgccagtcatagaggaaataatcatgaagcaaagctccacggataatatcacgctcttcgctgcgtatccccagcttctgcagcttttccctgatcgacagactgcattcggccacgctgatactgtggctgtgtacagacacctttccgtgctgcatatttttccgtgttttctgaaaattgacggagtgcagaatatctccgccgttttgactgatgctttcccggatcctccggcgccgttccagccgtctggcctgtttctccagctgccggactgtcaattccctgtttttcatgcttgatctcccaaaaaaattcataacatttaagagtggaacaattacaatgccttttctttaataatagcagacaatcggaaaattgtgctccatatacccataaatgatttccgccttatccttcggcagattaatacatccatgggaaccgtttctcatataaatatccccgccgaagcttctcctccagcccgcgtcatgcatcccgatattaccattaaagggcatccagtaatccaccggcgtagtataattttcaccccgcagcgtggcgttacgttctttataagtcagaccgaataccccggcaggcgttccaaatcccctggatatattgccggacacaaaatcactttccagtataatctctccgtcaatataaagatacaaatgctgatttcccatatctatttccacataggaactgccgatatcctctcccggcctgcccgtggcatagccccgtgcaaaatacagaggctctctttccacccgctccccatttctgacagacgcaagcaaggcttctgtttctcccgcccgatccgtccaccagccataggaaccgctctttaacagaatagtatctccatttgatgtggtaaaattacgatctcttccataagtatcatgtttttttgccagtccgttgatatatgcccttaccgcttcttcatccagctccacctgactgccgtcaatcgtaatccatccgctgatcaaatcaccgtcaatgacttctttttccccgttccaatcgtaggtcacttcagctcccacataccggttcgctttttccaaagctttattcagagccttatcatctgctttaaccgccgcatcgctgtagaagcctccctgggttaaatccagagtatcctccatatcttccagcgctgccgccaccgccgccttcaccttgtcaaaatccagcacagtacccggatactcctcaacaatctcatagcctttatccgggctgtatgcaccaatataggcattcaccggcgcatgaatattcgccttatcaaaaaagacagtgcctgaaagcctttccttcagagccttttcactgtaagtaaccattttaggcagttcataatgattcctgtaaaataacatcgtcggccatttcagccctgtcatctcggcattcagcctatccagggtatcatcaaatacatatatcatttccagctcggccggagtcatggtatcttccaaaccctctctgcccttgatctgcagctcatatgtaacagacggattcagcagttcttccctcacctgttctttggaacggaagctgtaatccgtaccatctatccaggttctccagtaatagtgaccagcaaaaaagaaggtacctgcaagataaataagagcagccgctgccgcaatacaacccgcagcaatcattgcccttctgaatgcagtcccccctctttcttcctgcccgtctttcaattttcttttactcattcgataatttcctttgtatcttctttcctttctattgtaacacctttccttaaaaagaaaaatagataaatactgtatcgactgagaaatacaggtaattttattacaattcactgcccttttgtgcccgccccgccgcccctgggatgccccaccccgctttggcctgtcccgccgtccctgccgtccgccctgcgcggcgctgtcctgtaaggattcctgaaaggggcgtcataatcacgccggtcctttggctgcgtcctttgcagccttagtaccgttgcgtgattatccgagcggaagcgtcccctgcaaggaaccttacaggacagcgccgcgcagggcggacggcagggacggcgggacagaccaaagcggggcggggcatcccaggggcggcggggcgggcacaaaagggcagtgaattgtaatgtaattcttactcgaactgtgcaagatacatctgtctgtaaaggccgtcctgccggattaactcctcatgggttccctgctgcacaacatctccgtcatttaccacaagaataatgtccgcattctgtattgtcgacagcctgtgagcgataataaaacaggttttcccctccatcagctttctcatcgcttcctgtattttcatctccgtgcgtgtatccacattggaggtggcttcgtccaatataagcattcttgccggaagaagcattgccctggctattgtcaaaagctgcttctggcctttggaaatgttcgtaccctcgtcggtcaggatcgtgtcatagccctgaggaagcctgcggataaatccgtctattcctgccgcttcagccgcctcacggactctctccacttccattttctgctccatcccgccaagacttccataagccagattttcatagatacttccctggaacagccatgtatcctgcagaaccatggcataggacttgcgcaggctctcgcgcgtaatccgggacacattcataccgtcaacacatatacttccatcctgtatatcgtaaaaccgcataagaagattgataagggtggtctttccggcgcccgtaggccctacaaccgctatcattttaccgggtttcacatgaaaactcaagtcatggataatagttttaacagaattatagccaaattttacatgggaaagctccacatccccttccacctgcttaagttccatggaatccggcgcgtccacaggctcttccggctcgtccagaagccggaaaatacgttctgctgccgcgatggaggactggagatcactgataatattggccgcttcattgataggacctgaaaatttcctggaatacagaacaaaagaagaaatatttccgatgctcatacttccgaaaagatacaataccgccccgaatacactgataagtgacaaagacagattattcacgaaattaaccataggccccacaatgctgccgtaatattccgcccggtaataggccttcatagccttttcattcttctcttcaaagcggtctattgtatgatcctcctgacagtaagcccttaaggtcttctgtcccgataccatttcctccacaaaaccatttaattctcccagtttcgccgacctctccctgaaaagaggccttgtttttcctgtcaggtaacgggtgatgcatatggacaaaggcatcgtaaaagcgaagaccagcacaagcctgggcgaaatcagcaccatcatcacaaaagcgccgctcaccgtgatcactgtagtcaaaagctgaaccacatcatccgaaagtgaagcattcaccgtatcaatatcataagaaatccggctgataatatccccgctctgatgtacatcaaaatatcccaccggaagggaaagcagcttttcgaacacatccctgcgcatccgatataccaccttccggcttatcgttatcatcaatacctgaagcaaataagaaaaaacagaggataccacataaaaaaccgccatccaggccgcataatagaaaactctgctgaaaattaccctccccggccccggttcaatcgcatccaccgcatacccggaaagcatcggcccgatcagggcaaacagattactgcctactgtcagcagcagcgcagcggcaagataccacttataatgcatcagataaccgcccagcctcagcagagtaccctttttccctctttcctttttttcctgtttatcctttttttcttgtttacccttttcttcctgtttacccttgcctccccacttcataccactgcctctcctgtctgtgaacggctgatttctttatacacctgacattgttctatcagctcctcatgggttccataaccaatcatctccccatcctccaatacaagaatatgatccgcatgcataaccgaactgattctctgggcaatcataatagtggtagtatcccgaaaatgctctttcagctgtttccggagctttgcatccgtccgatagtccagagcgctggaggaatcatccagtatcaatatatccggcttcgctgccaaagccctggctatcagaatacgctgtttctgtcctccgctgaggttagcccctttgatatccagcattgccccctcattacgttccttctcccgtgtaaattcatccgcctgcgcataacccagagcttttcttacatcctcacgggacagttcccttcccatcctcacattctcaaaaatagaatcctcgaaaataatgtcattctggaaaacaaccccaaactttttctgcagctcttttttttcgatactacggatatcctgtccatgtatcagaatcctcccctgatccacatccataagccgcataagcagcgccgccaatgttgtctttcccgatccggtggctcctatcacgcccagcatttcccctttattaacacagaaggaaatatcattcagatttggttcatttttattgtaagaaaaggtaacatggtcgaatacgatctccccgcattgcccctgctcttcttttccggccccttcaccgagcttttctccaggcttttctccaagctcctcaccatgctcctttccagcctttactccacactcatctccaaaaatacgcaccatatcctcttcgcagtccagcacctgttctattctcgccccggatgcaaccgccttatttattatcacaaacatacgggatatggacatcatggcattcagtataattgtaaaataagtcatgaacgccaatattttacccacttcagaagttcccgcattcacacggtaggcccccgccagaataactcccaccagtccaaggtttaaaagtatattcattgccggattcaggacagccatcgtttgttccgcatttctttcgcaggtaacgaccatggtattgactctgtcaaatttatccttctcataatccattttagacaacgccttaatcactctgattccggcgatgtcctctcttaccagacatacgaacttgtccgcagtttcctgaagcttccggtacaaaggcatacccttccgggataccgccgccataaccagcgctaaaacaggcataaccaataagagtatggatgccagcacaggatccagcgccatagtaaaaataatcccgccgaccagtaaaataggggctctcactccaagcctctgtatcctgcctatcatctgatttacattatatgtatctgtagtaagccttgaaatcaaagatggtttggtaaaagcatccgtctgcctggccgataaatacattgttttcgcaaataggtcatgccttataatctgcgtcgcctcactggcaaccttagatgccatacggttcgcaataatattaaaagcaaccgcaacaaaagaacagaatatcatcactccgccccaaagataaatcttctgcagacttttcatgggaatcacattatcaataacataagcaagaacccagggaatgcacaaatccataatagatcccgtaaacttaacggcaaaaccaatgcccatccttttataataaggctttaaataaaaagatataatcttcttcattttatatccagttctcttacctttcttaataaaaacggctgtatatcaggatatgtccagaaatccttcctgtcaggaaactcatcaaacagtcttgtctccttgatttcgaacgccggcaaagaccccagttccttcacatcagcataatacagcataccaaagctggcatctcctccctgcttcatacaggaatacgcacaaattggccgaagtgtataatcctgcgccccggtttcctcaaacagctctcttcgggccgcgtcctcaatcctttcgcctttttccctgtgccctcccgggaattcccaggttgtcctctccttatgacggcataaaagccactttccatccttctttgcaataattaccgcaaaatcaaatacggaatcttcagccgtgtcgtaaaatgctacctgtatcatttccctgctccttctcgtataattcctgatctttgaaaatcttcttattacttaaattatataccagttcacaacagttgcaaagtcaagtatcccaaaactgcagttttacctatttttatttacaaaaaaaacctcagctataaaactgaggtttttgtactgaagcacgggggattcgaacccccgacaacctgattaaaagtcaggtgctctaccgactgagctagtgctccatatcccatatttaatttgtgacagtaagaaatgcccagaaccggaatcgaaccagtgacacgaggattttcagtcctctgctctaccaactgagctatctgggcatttaagtagcggggacaggatttgaacctatgaccttcgggttatgagcccgacgagcttccagactgctccaccccgcgttaatgaatatattgtaacacctaaacggtatcacttgcaacttttatttgagaaaaaatggatggaggtggattcgaaccaccgaagcaatttgcagcagatttacagtctgtcccctttggccactcgggaatccatccataattattaagttataagccgatgatcggactcgaaccgataacctgctgattacaaatcagctgctctgccaattgagccacatcggcatatgctaaatccgaacaatcggtaaccttaaacgtaagaaatgggacctatagggctcgaacctatgaccctctgcttgtaaggcagatgctctcccagctgagctaagatcccatacctcatatctgatttcttattcagaaatcaacgacccagatcggactcgaaccgacgacctccgccgtgacagggcggcgctctaaccaactgagccactaggccgaatgaaactttcgtttcaaaaggatatatcagaatataccctcaaaaccgaacattgaatttaatctcttccaaactatccaaaacctgctttcccataccttcaggataagccctcgaccgattagtactggtcagctacatacattactgcacttccacctccagcctatctacctcatactctctaaggggtcttacttattgggatatctcatcttgaggggggcttcacgcttagatgccttcagcgtttatccctgccggacttggctactctgccatggctttggtagccaacagattcaccagcggtccgtccatcccggtcctctcgtactaaggacagctcctctcaaatatcctccgcctgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagtcctactttcgtacctgctccacccgtcggtgtcacagtcaagctcccttatgcctttgcactcttcggatggtttccaaccatcctgagggaacctttgagcgcctccgataccctttcggaggcgaccgccccagtcaaactccccgccagacattgtcccccgcccgggtcacgggcgcaggttagaaacccaatgctgcaagagtggtatcccaacagtgactccatgattactggcgtaatcacttctcagtctcccacctatcctgtacatacagcatcgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcggagcttcgttgcctgactcctcctcttaaccttccagcaccgggcaggcgtcagcccatatacctcacctttcggtttcgcatagacctgtgtttttgctaaacagttgcttgagcctattctctgcggcctcctttcagaggcaccccttctcccgaagttacggggtcattttgccgagttccttaacaatgcttctcccgccggccttaggattctctcctcatccacctgtgtcggtttacggtacgggtatcatatgaacaatagcggcttttctcgacagctggctcacctgcttccctacttgaattcggtacgcgtcacgccttcggattgctggacggatttgccagtccagctcctacttcgcttgcaccgggtttccctttcccggctcaggctttccctctgtttccccacagttctgtcatatgatagtacaggaatctcaacctgttgtccatcggctacgtctttcgacctcgccttaggccccgacttacccagggcagatcagctttaccctggaaaccttagatattcggcctggaggattctcacctccatctcgctactcattccggcattctctcttcttaccagtccacaataccttacaatactgcttcttcccggtaagaatgctcctctaccaatgtgattactcacattcctaagcttcggtgtcgtgtttcagccccggacattttcggcgcaggacctctcgactagtgagctattacgcactctttgaatgtatggctgcttctaagccaacatcctagttgtctctgaaatcccacatccttttccacttaacacgtactttgggaccttagctgtaggtctgggctctttcccttttgactgcccaacttatctcgtgcagtctgactcccgtacatcattcctatggcattcggagtttgatattcttcggtagactttgacgccccctaggaaattcagtgctctacctccatggaattaatacgaggctagccctaaagctatttcgaggagaaccagctatctccgggttcgattggaatttctcccctatccacacctcatcgccacccttttcaacggatgtgcgttcggtcctccattgccttttacggcaacttcaacctggacatggatagatcacccggtttcgggtctgcagatactgacttcgtagatgcagagcatctatcacgcgctgttaacacttggtttcccttcggctccgtccctgaaggacttaaccttgccagcacccacaactcgccggaccgttctacaaaaagtacgcggttgtaccctgatggtacttccacagcttgtaaacacaaggtttcaggttctctttcactcccctcccggggtccttttcacctttccttcacagtactatgcgctatcggtcactaaggagtatttagccttacggggtggtccccgcttattcccacaaggtttctcgtgtctcgtggtactctggatcctgctgtccaaacttggttttcgcttacggggctttcaccctctctggccggtctttccaggaccgttctgctaaccgcatctgtaacgtatgcagtccgaaccccagcatgcacgcacgctggtttgggctcttccgttttcgctcgccgctactcacagaatcgatatattttctttctcttcctccggctacttagatgtttcagttcaccgggttccctccgcatccctatggattcagaatacggtgacggaggtttgctccgccgggtttccccattcagacatctgcgggtcataggatatttgctcctcaccgcagcttttcgcagcttatcacgtctttcatcggctcttagtgccaaggcatccaccttgtgctctttacagcttaacctgtttgtaactcgtccttacttggtctcgttacggcatacatagcgttgtatgctctttttggtatttcttcccattctttcgaatgggttattgcttgttttggatgtcttctcgtttatcttcttctatccggttggttccttttacaaaaccttccttttagacgttgatactttaagattattttcaatattcggttttcaaggtacattcttgactgcatattttatcagtcattcaaaatcaggattgttcctaattttgaatcactggtaaaaccagtgtatataaagcttgttcagcttgtttttgttgtaatccggcagccacctgctctcccataccgtttccagcatagtaccatcggccgcttaagtcttaaccatcgtgttcgggatgagaacgggtgtctcccctaagcgtatcgccaccggaatccttttttcctgatgttcccagagccttccggctccctcaacatctaaacagtaatacaacccctacttcttcgccttagaaaggaggtgatccagccgcaccttccgatacggctaccttgttacgacttcaccccagttatcagacctgccttcggctgctcctccctttcggttaggtcacagacttcgggcatttccaactcccatggtgtgacgggcggtgtgtacaagacccgggaacgtattcaccgcgacatgctgattcgcgattactagcgattccagcttcatgtagtcgagttgcagactacaatccgaactgagacgttatttctgggatttgctccacatcactgtctcgcttccctttgtttacgccattgtagcacgtgtgtagcccaaatcataaggggcatgatgatttgacgtcatccccgccttcctccgggttatccccggcagtctccttagagtgcccagctttacctgctggctactaagaataagggttgcgctcgttgcgggacttaacccaacatctcacgacacgagctgacgacaaccatgcaccacctgtctccaatgccccgaagggaacacctctttacaggtgcgtcattgggatgtcaagacttggtaaggttcttcgcgttgcttcgaattaaaccacatgctccaccgcttgtgcgggtccccgtcaattcctttgagtttcattcttgcgaacgtactccccaggtggattgcttattgcgttagctgcggcaccgatgggtccatacccacctacacctagcaatcatcgtttaccgcgtggactaccagggtatctaatcctgtttgctccccacgctttcgagcctcaacgtcagttacagtccagtaagccgccttcgccactggtgttcctcctaatatctacgcatttcaccgctacactaggaattccgcttacctctcctgcactccagcctggcagttccaaatgcaatcccaaggttgagccctgggttttcacatctggcttgccatgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcaccctctcaggccggctactgatcgtcgctttggtaggccgttaccctgccaactggctaatcagacgcgggaccatcctgtaccaccggagtttttcacacagaaccatgcggttccgtgcgcttatgcggtattagcacctatttctaagtgttatcccccggtacagggcaggtttcccacgcgttactcacccgtccgccactaagttataccgattccatccgaaaacttcctctgtctaacttcgttcgacttgcatgtgttaggcacgccgccagcgttcatcctgagccaggatcaaactctcttgtttaagtgtttaatccggttaagattaactctagctaatgtttaaccgtttgtttgtttccaaacatttcttactgtttttgggtgtcttaaaggtcttctctcgaagctttaaaacttgttctctgaattttcttttttagaattttcagggttgcattactgtttatttgtcaaggttctgtgtgctgctttctcagccgcaacagttgatatcttatcacatgttgttctgccagtcaagcacttttttaactttttttatttcttttaaatctctgttccatcgccattcgcggtggactttcattatagcaccatattttgtcaaatgtcaacaacttttttaacctatattttccataagttttactcgttcttttcatccggcaaaagtgcgaaaaaaaagaaatctcaatctcttaagattcttttcccgcgaagctataatcaagctcccctttatatcggtaaagggaacggagaaagagggatttgaaccctcgcgccgctataaacgacctacacccttagcaggggcgcctcttcagcctcttgagtatttctccacaaaactgaactatcctctaccaatatgaagtgcgcgtcccattcggtagcgcaaatgttattatacataaggcgtaactgtttgtcaattctttttggtaagtttttaccaagttttttcatatacccgggaacttcttatgcgagaggctctttctgagtatatccggcaattgtttcatctatacgtctttttacttcttctgctatttgtgttgttttcatatccttatattcttcatagtacatgggcttcagatagaatatctttacggtaaccctcctgatgctgttttcatcaaaggggatgaaagaatctatcagggcacagggcactatgggacatttggctttcatagccgctttaaagctgcctcccttaaattcaagggtatggttgccctgtcggctcctggtcccttccggaaaaataataaagttgcggcctttttttacttcttctgccattgcctggattatcttcatggactgtctcagatcttcccgatcaataacgagggctcccagagccttgcgcacctgtttgagaagaatgacattggcggcttcctttttcattacaaaggaaaagaccttcggacaggattccaggaatacgaggccgtcaaaaaggccctgatggttgggaaacataatgaacccgtctttttcgggcaggttttccacgccatgggcttcaattgtcacacggcctgccttattggcggcgagggttgtctttttacaccacctgaagccttcctcatagctgatgctttcatggatactgcaccaccagatgtggctgaaataataaatggctttaaagaaaagccggaagaccatcaaggctattctacgcatatttgattctcttttcctttttattctttacaatattgctttatggcggtttcgtaaagattatttccctggctgtccattaccacaacaacaggaaaatcctttacggaaagctttcttaccgcttccgttcccaaatcatcataagcgatgacctccgagctgaggatggatttggaaagaagggcgccggcgcctcctaccgctgcaaaatatacggcgccattgcggatcatggcttctctcacttcttccgtacgttttccttttcctatcattccctgcatccccaaatccagaagggcaggggtatatttatccatacggcttgcggtggtggggcctgcggaaccaataggccgcccttctcttgcgggcgacggccccatatagtatattacatttcctctgatatcaaacggaagggcttcctttttcataagggcttcatacattcttttatgggcggcatccctggccgtgtatatggtccctgtaagatagacgtaatctcccgatttcagggtggccgcttcctgtctggtaaagggcactctcatatgtttttccattctgttcttcctccggtcaaacggctttcttcttattatatatgatactttatctgcagatatggtattacttagattaagaactaccatataaagggttctacagggttcttacggaatgtctgttcacatgacagcagatatttacagcaacgggcaggcctgcaatatgtgtgggataggtattgatatttactcccagcgcggtggtggttcctcccagtcctccgggaccgatccctgatcgatttatcctttccagaagctcctcctccatttcctttatataggggatttcggaatgttcatttaaaggcctggtcaatgcctgtttcgccattagagcgcatttttcaaaagttcctccgattcccactcccacaaccatgggcgggcacgcgttagggccggcttctttcaccgcagtgagcaccgcatttttaaccccttccattccgtctgcaggcttcagcatgaaaacacggctcatgttttcgcttccgaagcctttgggcgctaccgtaatctttatcttttctcccggtacaatggtatagtgtatgattcctggggtgttatctccggtattttcacggagcagaggatcgcctaccacggatttgcggaggtagccttccttatatccccggcggattccttcatttaccgcatcctcaagcgccccgccttcgaaatggacatcctggcctatttccataaaaaccactgccattccggtatcctggcaaatggggattgtatcctcccttgcaatgcgcagattctcctggagctgtcccaaaacctgctttcctaaagccgcctgttctttggtgaccgcatggttcagggcctgttccatatcttctgtgagagtatggttggcttctatgcacatttcctttatattttcagttatctcggatacctgcactgttctcatttgcttttcatcctttcccgtaacgtcactgctctgattctcttcattatagtatagtttcttttctttgtcaccagcgttttcccctgttggggcgggataaaccgaagatactgccggctgccggacaggatggcgcacggacggatgcggagcgaaggataataggagcataaggtcacagcgcagacgatgaatagcctgacgaaagaatgaacctttttggctgcagtctgatatctttttcattttcccttgtataccggcttttcctatcataaaatagacaggacagtatgtgtggaattctataagaaaggatggttattttatggatagaaatgtgcttctgctaaaagaaatgatacgctattatgccagggatcccaaaaggattcagcattttatcaaggttcatgattttgcaggcatgataggaaaattggaggggcttgaggatgatgagcagaatattctggaaattgccgctattgtccatgacatcggcattaaagtgagtgaagaaaagtatggggactgcagcggtaagcatcaggagctggaaggtccggttatcgcaagaacgatgctggaacccctgggctttgaggactctgttattgacagagtatgttacctggttgcccatcatcatacttatcaggatattaacgggcttgattatcagattcttgttgaggctgattttcttgtgaatttatatgaagacaatgcatcccgtgaagccgcggaacacgccctgcagcgtatcttccgcacagaaagcggaaaaagcatatgcagggacatgttcgggcttacggaaggaacggcggatcaggccggtacgatttcaatccagtaaccgtcgggatcctgaatgaaataaattcccatggcttcattttcaaaacagatgcatcccatttctttatgacgggaatgggctgcctccatatcatctacggtaaaggccagatggaattcattatcgcctaaatcataggaagctttttcccagtctctcagccaggttaattccagctggtgaggtgtggttccatcggaaagaaacgcaagcgtgaagcttccgtccggagcctctttggtgcgcacgggcttcaaatcaagggcctcctcgtagaaacgaagcgatttttgaagatcctttacattaaaattattatgggcaaacttaaatttcataggtacctcctgtgaatcggtattatttactgttatgtgcattttatatggagtgtatgcggaatgcaatagtttttttatgaatgacaattcagagaaaccgctatatactaggaatatgacagaagaaatattcaggcaaaagaaaaaggagattgttccatgaaagcacttcttgtattaatcattattttgttactcttattcttactttatatggtattaattatgcctcggttccgtaagccggattgtaaggctcttctacatcattattatgcgcacaggggacttcatgatctatctgcgggaataccggaaaactccatgaaggcctttcagagagctattgacaaaggcttcggcatggaaatggatgtccagctttccagtgacggatatcctgtggttttccacgattccacactgacacggatgtgcggggttgataaacgggtaaacgagctgacattaagggaactgaaggagctgatactggcggatacccaggaacagattcctacctttcaggaatttctcgatctcgtaaggggacaggttcctctgattattgagattaaaatggataaaagggatgaccggattccggaagctgtgaaccgtctgctaaaggactataagggagtttactgcattgaatccttccacccttcggctcttatctggtataagaaaaaccggccggatgtattccgcggacagctgtgcaccaattttaacaaagagaataaaaactgcagccttcctttttttctgttgggaaaaatgctttccaacattgctgcaaggccggatttcatagcctacaactgggtttaccggaatgatttgtccagaaaaatatgctgtaatttttatcatgccctgcctgtgggatggacaatccgttcccaggaggaaatggatatgtgccggaaagattttaaactgtttatttttgagaactttataccgaagggggatgcctgatggataaacgccattttatctttgatatcgacgggaccttaataaatacggaaaaggctatcataaaggggcttcaggagcttcttttggagattaagggagttccttatgaaccggagcagctctatttctgcctggggatccccggccccattactcttaagcagctgggggtggaaggcgatctcactgcaatccttaaaaagtgggatgcctattattgcaagcatggcggggatgttaccatttacccggatattcctgaggttctgaagaaactgaaggaaaatgggatttcactcggagtaataacctctaaaaaccaggaagaatacgattatgatatgatacggctggggctcgcggattatttttcgattacggttactgccacggatacctcagagcataagcctgacccggcgcccatgcttttttatctggagaaagcgggaattcttcctgagcaggctgtgtatatcggggacagtatttatgatatgaaatgtgcggagggcgcgggtgttccgcgagcgctggcgttgtggggatgcaaaaatccggaggaaatcactgcggattacaggctttcccggccgattgacattctggatctgctataagtaagcaaatagattaattgatataagaaaaggaacaccattcaacggtgctccttttcttaatataattaattgtccgcctttgtaatatcttcatatgataaaataaagagtttatccgacaaataagttaacataatcttgctcttttgagtattccacttataagaaaggatatccttatcatgatcgccgtacaggctatccatctgctgaatgtattcttccaacaacgcctcatccgtataggaactatcatctgaattcgtaatatacagcgtaatcttgcttaaagtaacatcagggaaattataggagactaggacatctatcccttctttgccttcataatcaatattattgactgcgattaaatttttttcatctttggtgagtgcatcctcgggcagacgtttcaacacttcatcgtaagtcattccccattcaaaaccattataaagaccactcgtatccggtttgtttgtcaacttaaaaacaccaaagccgacagccgccagcagaagtaatgccagagcaatgataattattagtttaacaagtccttttttcttattctccgctgtttcagttgctgcagacacttccacaggacagccgcatttaggacattccgttgctttatcgctgatctctgccccacattctgaacatttaataagtgccatatcgacgttctcctttactttttattcattttttccggcatctggctgtctaatttatcataggcagacataaaatcattgaccgcatcagatttcatggaactgaagccattgtaattaccggatggactgatggccatatcggtaagtgatttatatgcttcatataaatcagaaatggtatcataacacttatccaatccgtccggtggtgtctgtaattttttcattaatgtttttatcgatgtctggtttgtttctatatttgatatggtggttaatgtcccggaatcagaatataaaatacttagtgcatcattaaaatcatcataaaacctaccggtaccgtctttttgtcttgtgtatttatctgtctcactgtctttttctttataaatggaattactccatacctttaaggtaagattacataatgtctctgcctcactgccgcctgaaagcataagtgactgtgcttttttcaaatcatctatgtaagtattatacgcttccctgtattctttcgccgctttcttatcggaatacactttaaaaccagcgcctcctgcaatacaaactatcaaagctataattataccgatgatcagctttttggttttctgtgtcattgtaatgccagccacttctacctgctggggttttatttccacggcttttttatcttcttcaaccgggcagccgcagctcggacacacttcaacattatccggtaataattccccacactcagaacatcttttttcctccggctgtggatccgaatcaaagatttttccacaatgaatacatctcttagccttatcagatatatcttgtccacactccggacatttaataatagccataacatcccccgctcctcataagttttttgtaaatatgccatattatttgtaaattatacccctatttttatgcaaagtcaaacaaacatatatactgtataataaggtaatatcttcctttttagttctatattccgtatcagagtacagaatagggtgcaaagcatcatgggatattattcactaaataaattcctgtaccatctttcatccagctatataagattttgacaaacaaatatccctgctattattaaaacagcagggacgtttgttaatacagtaagggtaaagggagggtattttatccgtttataacggctttcatctatataaaaccggccataccggcagaatcaggaaataaaacatgatccgggcaataaatctcagccctctataggaatgatggtcttctcttcttcgattttcttaggctgcggcttgtcaatcattatccgaagaataccatccctgaatgccgcatggatttcgttctctgtaatctcttcacctaaatagaaggttctcttcatggttccgtaatatctttctttccttacatatttggttctctcatccgcattttccacaggctctttcctgtcggcggtaatggtgaggtagccgtcctttaattctgcctttacatcttcctttgtaaaaccgggaacctcaatctccagaaggtactggccatccttttcacggatgtcagtcttcatcagctgggtctggggcgcatagcctctgttgaaaaacgggtcatcaaacatatctccgaaaaagtcgttgaaaaaattatttctgattaacatagttcattcctcctgattttatattgaaatcttccggcttaactgccgttcctttgttgttctataacatttataacactagttgttagcactgtcaagaggtgagtgctaattaatttataaaaaaagtgtgaacttaattttaaccgggaatcaggagtacgaaagtgttcttttaacgcaataaaatatttatagtatagaaatatagtaaattatatgctatagtatttattattaagtgtgtcaaaattggtaaaataccggaaaggaaacttcatcatgttaaaaacaattgatttcctggatcagaatattctttgccgtcatgtttcagatttggcaatccatccttattaccatcggcacaacggctgcgaaatataccttttcctgaatggaaaggtcaactattatatcgaagaacactgctatcctctggtaaggggagatattcttgtaatacagccggaggagtaccatcgggtggagctggtggataaaaagcattatgaacggattaccataaatctggagcaattcttttttcagtcgctttccagccatgaaacggatctgaccacgtgctttttcaacaggccggccggccaaaacaatctgtcttttcttaatgaacagcaaatcggggagtttatcatgctcttcaaccatctgaaggaagcgaacagcagtccggaatatgggcatgatctgctttccttatcttatctttttcaaattcttgtaatggtaaatcaggccttccgggcgggtggaaaccagggctgccgcagtatcatgccgccgctgatcagggatatcatgctttatatcgatggacatcttctggacagctttacgctggaggatctttccaggcagtttttccacaatccttcctatataagcaggcgtttcaaaatggttacggggctgactattcagcagtatctgctcaataaaagaatcgggcttgcccagaaatatctgaaggaaggcaggtttctgacggatgtatgctggatgtccggcttcaataattactctcatttcgcacggactttttcccagcaggtgggtgtttcacccaaaaagtatcagaactatattatgtccctgccggaaaacgcagattttcaggaatctctttccgtatgtgaatcagaataggcccgggataatatatccgcgggcctgttgttattaatatccgtatacttctgtaaaataagctgtacgttcttcaattattgtttttataccggcgtcctcactggctttcataaaagcatcgtagttggcgtcaaattccgattccggacaggttatgcactgtaccatgtattcgctgcggacaagggccaaatccgtctgaaggtcgggtgtggagggcgaggtatagaaggtggcgggaatgcaggtccctgccatggaattctcatagttttctatcacatgatcttcatagccgggggcttctttggatgtgcatgcattaaagtcatccacggtttcaaaatatccctgatttcccaccaggaaaatatctgtccgtatccagtctttgtctgcgctgttgtatgcggcatccttgactaccggtattccggcatcatcaaagtcataatgttccccttcaaagccatgatagagtacaaaaccgccttcctgggtgcactgccagtcaagataggtcatgcaggcttccacgatttcggcatcggctgttttgggacagaaggcgatcagtcctccttcggaataggtcgcgctgtactgtactccatcgtttacgttcttcaatgcggggatggagataatatccgcatccggatcgttttcctgcagtgttttcagaagggatcctctgagcacatccacgctgtagtttacattggattcaaaaccgcccatggagccggtaacaatatcgctgttaaaggtatccgtagtcatggtgtagtattctttatccatgagcccttcgttataaaacttattgatatacctgaaatattcacgcattccggggtcgtaataatagtcaaagccatgggctatgtcaatttccttgggctctcctgccaattgggaaaaggcaagggacatacagtttctggggttatcgccgttattcactccccagaaggacattccaaccacgccgtttttgccgtccgggttgttcctcaccatctgtgtgaccacatcgtagaactcatccgcagtcgtgggaatctccagtcccagatcgtccagccagtctttgcgcagaaaaatattggaattagccgttgtggcgcgtttggcaactatgccgtacaggtttccttctgtatttctgccgatatcgataacgctgtcgcccaggtatgccttcatattctgagcctgtccttccccgtcgatgaattccgataaatcccagataccgccctggttaaagtaatcctcggcataggaataggtataagttatggttatgtcaggcgctgtgccggaggacatgagtgtctgcatcttggttacttcatctgaacggggaacggaaacgaattccacatggatgcccacttttcccatctgttcattcacatattccacccatttgttattcagtatcgtgctgccttccggggcattgctcctgtcaaagagctccactgatatggtaacatcatcaaacatcttggagccataggttgtctggtacccctccgctgttccttcctctcctgctgccgcccgggttccggattcatcaccggaagaagatgcctcccccgatgatgcctggcctcctgccgggctgctgccgcagcctgcaagcatgctggccgtcaggaacagggccatgaatgtaagacttccttttttctttttcatatctttccttcctttctgttttactagttataagaatattttattttctttgtctcattcaggatgccgtaatcatcctttgacggagccgagcattacccctttgacaaaatatttctgcagccatggatatacaagcaatatgggaattgttgaaacggcgacgcaggccattttcagggactgggtcatcacctgggtgccgatgccttccacattgcctccgcccgcattgttcagctcgtccgcaaaaagaaggctgcgcagcctcagctgcagggtgaatttatccggggactggatataaatcaaagcgtcaaagtagccattccagtattggacggcataaaacaggccgatagtcgcgataatgggaaccgaaagcggaagaacgattttcagcagcactcccatgtcggaggctccgtctattttggcggcttcttccaggctttccgggagctgccggaaaaaggtcctcattacaataaaattaaatacgttgattgcctgcggaatgtacagggaggacaaagaatcatacattcccagattttttaccaccaggaaggtgggaatgatgccgccgctgaaatacatagtaaaaagaatcagtcctgaaagcagctttttgccgggaaggttctttcttgacagggcatatgccgcaaagatcgtgagcacaagcccgatagccgtacccatgagtgtgacgaagatggttaccctcatggcaatccatatctgtgctcttcccagtatctgtttataggcatccagggtgaattctatgggataaaaggtcacatctccggagagcaccgcattgtagccgctcagggaatatgccagtacgttcagaaacggataaaggcagatgaacaccagagcagtcaaaagaaaataaagcacggccattcccatcgtaaatttatgttttttccctgtttttgttccgggatttttcattttcttttcccctttctatataatgccttcttccccaatcgccttggcaaaccggtccgcggcaaggagtatcaggatattgaccaccgactggaacaggcctatggcggtggaatcactgtacttggcattttcgataccgatccggtatacataggtactgataacctctgaaacagccatgaccttgtcatttcccagaagcagaggagcgtccaggccaatggtcatcattttggagacctgaaggatgagcatggtaaccaccaccgatttgatggacggaagggttacataaatcagtctctggagcttgctggcgccgtccagataggccgcctcatataaggattcgtccacgccggtcagggctgccaggtaaatgatcgtcccccagccgatctctttccaaacgctgcagatgacataagtcacaatccaccacttctcatcactcagaaagggaatgctggaaatacccagggaattcagtacgagattaatcgtcccgtctctttgggtaaacatattggcggctattcccgcgactaccacccaggagataaaatggggtaaatacagaatagactgtatcatctttttaaaacgcagatggatgacctcattgagcatcagcgccacaaagatcgtcaggggaaaattaacggccagagtaagcaggttcagcacaagagtattttttacggaatgccagaaatttttgctggcaaatattttttcaaacactttaaatccaacccaggggctttccagcattcccttgaaaacgttataatctttaaatgcgattgtcacgccatacatcgggatgtatttgaatatgatgtagtacgccacaacagggagcagcatgagataaatccatttcagattccacatcaattttaaagtttttgctgcttttttcctcctgtcagcagaatttttaaccattccctttcctccttttcggtattttgatgtgcatatagcatacttagctttattattttggaatattctgtacacatttaataaaacaaattatatattccgcaaagttcattttctacacttcaaacgacctgttttttgcgtgtttttaccttttgccccatatatatttccggcgccggaaagaagggacatccggacagaggggacagccggagtctttttcgcggccggccggtcaggaatacaattgtttttggttacagttcagccttcagccgccgtctgtgccagtcccgcagcccttgccgccctccttttcccagcccgcctgaccttgccctcccctgtggggcagcaccctgcaaggattcctgtaaggggcgttataagcgcgccggtccttaggctgcgtcctgtgcagccttagtaccgctgcgtgattatccgagcgggagcgtcccctctaaggaaccttgcagggtgctgccccacaggggagggcaaggtcaggcgggctgggaaaaggagggcggcaagggctgcgggactggcacagacggcggctgaaggctgaactgtaactgtttttggaaaaaataagcggatttgctggacagatcccccgtaatacgagtaaaatagaacgcagtaaaatatatttcttatgcgacaggagatttaacatgagtaaagtaattttaacgggcgaccgccctaccggaaggcttcatgtgggccattatgtaggttcgctgaaacgcagggtggagctgcagaattccggtgaatacgataaaatttttattatgattgcagatgcccaggctctgactgataatgcggacaatccggagaaggtgcgtcagaatatcatagaggtggcgctggattatctggcatgcgggctggatccggaaaaatccacgctgtttatccagtcacagattccggagctgtgtgagctttcgttctattatatgaatctggtgacggtttccaggctgcagcgtaatcctacggtgaagtcggaaatccagatgcgtaattttgagacaagcatacctgtgggcttctttacctatccaatcagccaggcggcggatattacggcttttaatgccactaccgttcccgtgggggaggatcaggctcccatgattgagcagactaaggaaattgtccacaaattcaactccatttatggggaaacacttacggatcctaatatccttcttccggataataaggtttgcatgcgtctgccgggtattgacggcaaggctaaaatgagcaaatccttaaataactgtatttatttgtcggatacggaggaagaggtccgtcagaaaattatgtccatgtttaccgatccgggccatctccgggttcaggatccgggaaaggtggaagggaatccggtatttatttatctggaggcattttccaatgaggatcagtttgcccgttatcttcctgagtaccagaatattcaggagatggaggatcattatgccagaggcggccttggggatgtaaaggttaaaaaattcctgaataatgttatgcaggaagaactggaacctatccggaaacggagaaaagaatttgaaaaggatatccctgaaatttataatattctgaaaaaaggcagcgatgtggcggaagcggaagccgctaatacgttatcaaatgtaaaaagggctatgaaaatcaattattttgaggacaatgctttgattcaggagcaggcggaacgttttgctgccgaaagggaataataccggtcatcaaaacacaggttccaaattataaaagacaattgaaaaagaatatacgcctccgggcgtacaaaagagagggaatcccgtacgcaggtttccctctctttctattgaatatattgaatacttatttctgttccttataatcccaaacgttccagttcgttgtccaaacgaaggatttccgcttcagacagttcccattcaaatgcgacgcagttctcatctgcatgggcttcacttcttaccccaaccagagccgttcccacgaaatctttctgtgtactccagtttaatgccacctgggatacaggacaattatgttcccctgctatttcatccatggtctttaaaagctcctggattttggagaatttgggttccctgaaataatcatagaaggtgagacgcagatctccgggttcaaaatccggcgtgtccctgtatttaccggaaaggattcccgctcccatggaaccataggtcatggaatcaattccccgggaagcgccccagctcatcagctgttcatactgtctttccaccatggaaaaggggggctgctgtacatcaacagtaagatatttttccgcttcttctatctgttcctgcgtaaaattggatactcccacgtaacggattttacccatgcgttttaaatctgccagggcggacatggtctcgcagatgggggtgtttacgtccggccagtgtacgaaatagaaatcaatgtagtcggtatccagattcatgagagagctttccacctccctcatggcatttttataggtagcctctttgcggaaatctcccttaaacacatccggcaccagtccgaatttggtggaaaggaggattttatccctgggtatggtacggatggcctcccccactattttttctgcggttccgttcccatagcatggggccgtgtcaatcaggttgactcccaaatccaccattctgcggattgcgcggatggaaccctcccgatccaccggaccgtaattttttcctccgatcgcccaggttcccacggcaagacaggatacctttacatctgcgtttttgaaatgcttatacctcatagtgaactcctttctgttcttttctgatttatttttttatccttttgcttttttccctgttttccattcctgtacttatatttcctcaaacagctgctctccttcaaaataccggtcaacggaataaagcgcgccgcccagatctgccgcgcggtcaaagtccaggccggaaaaaacgatggaaagcccctggggaatatggaaaaaaggagactgcttcaccagctcctgcagacgcttcaggaaaaaatctcccgcaagcgtataaattccctgaatgacaattatatgaggatcatacagcagcatgatattgcggattaatatactataataatcaatggacttttccacggcctttctcgcacatgcatctccttttgcggcaaggcgaagaatcttttcatagtcacagcttccgcttctgtcagccgcaggttctttttcccgcggaaatgctttttccagttcctgcatatagccgcacagggcgtcaggggaaacggctgtttcaaagcatcccttatttccgcaggcacaggccttttcctcagtctctctcaccgtaatatgtcccagttccccgatgaagccgttggccccctgcatcaggactccgttttccaggacgcagccgccggtagaggtcccggtggatatggtcactacacggcaggaggcatattccggatgctccgaaagctctgcgtagcctgcgaagcggcttccattattgatggtaattccggcaaacccgggaagacgggcctgcagctcctcctttaccggcagatctcttccccatgcctggttatgaatgggaaaacggaggattcccctgggggcatccactatcccttcaaagcctatggctatcccgcagatttccttttcttccagctttcctgcttcacaggccgcaaggaccagggcagagatatcgtccatgcataactcatagctgctgccatccgtataggggaggcttcttttgtccagtaccttacatgtcaggtcaagaagcgcacactttattctttcactcccggctgttatggaaatcacatagcgatgggcgccgttcagggcaaacagctcgggcttcttgccgccctcctccgtggaatttcctttccccatgcttcttaccagccctcttgcctggagctcggcaagtatcttggttatggtgggtacgctcagatgggcctgctcggccagctctcccgccgtcatgacctcccggctccgcagaagcgccagaatcagcctctggttatgatacttgatatttttgggtttgcggcttgtaagcatgcgctaatctccttttttatgtctgttaaaggctgtggattccctgatcatgggcattgtcgaagtgcagtcccagatatctggccgcttccctcaaaacaggaagataatttccatagcatacgcccagatggtgaatgtaggggccgaacatcaatttttcttcccaccgctgccagttatcagtctccatccacacataggtgcccgtggtttccggcccgtctgtggtagaggcttctcctgcaaaaagatagtactctccattcagttcatcaaatctgcatacggtcagctgtcccgccttcagttcaaagctttcctggccttccaccagggcggctttgctttcctcctttttcagggaataagggaaggggccgcaatgccacagcagctcggcattgtcattttccggatggcggatggtcagatccgcaaggaactccacatcctcatacaggctgcaggcacggagtatcgccatggtaaccgcaccgttcacatccgtttcacaggcaaggggcaggccctcatccgccatttcccccaataccaggcaggggcagatatccgccagggcgggaaaagcggaccagcattcgaaagctcccacggagcagttattttcctccatcagctgctgtaccgccattttgactgccgccgcctttcgcagatcttcttcttttgtctgagtacagtccatacgttggctgatattttcacaatagctttggaaaaccatgctgttttcttccaggattgtcttcattctccccactactgcggatggtgagatgggaacacataccatgccgaaccggctgagcagatccgcttcgtttgccatcacgctcatgaaaggaaccggcctgtctccgattttggcaatgcggaggcccttcacagcctttaccactgccgccgtcctgaggaaattttcataaccggaggcaaagcgggggcttttcgtctcacagttgaatatgtagctgtaggtcactccatatcttcgcatcaccttggtggctgcgaacatgccgcactgggtgtccctgcctctggcctcaaaggtgttgggcctttcatccctggctccccataccagcacgggcacccggaaggctgccgccactgccgctgccgcctgttcctccccaaaatcgcagaagggcaggaacagggcatcaattcccgctttttttaatttatccaccacggcgggcactttatccgcttcatataaaattccctgctccgcaatatcgtccacgtccacgatttccaccagctccggttttacccggcggataacggacataaatttgtttttctgtctcacggcttcttccatgctcagaaagcttctttttacaggtactactcccaatattaatttttgtgtatacatccccatcttcccttcttaacataatccccgtttataatactgtatccgttcttcaatttcccgataatcaatcctgcctgtttccatgaactcacgcacagtttcccaatccggtatccctgcccttccaccgattctcgtacatttgaccgccgatacggcgctggcaagacgggcggtttcctttgttgtatatccctgcaggagccccgcaatgaacgctccgtgaaaaacatcaccggcccccaccgtgtcgaccacctccacctgataggcggggagtgtgaaaaacccttcctctcccacgcccaggcagcctttgcttccctgggtgaataccacgatattcggccccttttctctgaggctgcggcagttcgcttcataatcttcattcccgaacagggctttgtagtagaattccgatccgatcataacatctatcaggccgaacgcctcttcatcgccgggagaataattatccgcatccatcactatggaggccccggcgcttttcgcccgctttatggcttccaatgtggtttcatttatctgggaaatataaaaatatgtggtattcttcaaatagtcgtcgggcagctcctccacctgcataaaacggaccggcgcttcaccgggataatacaggatactgcgtcccatgctttttttatcactgacaaccacgtcgaaaagtgtggtttccttttctctttttactaaatggcaggtatcgattccatgtgcttcaaagtctcttctgcagaactccccataggaatcgtctcccacggttcctataaatgcccctttggcatgcagtctcgccgccgctatcattcccgtagccaccttgccgccgccctgccagctgctctccaggacccgctctcctccgtctggcgtgggaaaattttccacattgatattcaagtcaacgcagggtgattccaggcccactatgtcaaaatgcatattccgtcaccacctttacagggcatagccgttgggattcagaagcctcagctttcctgccacaaaggccctgatatccttcgccgcctcttcctgaagccggaaaaaggatcctttttgttctgttttatcggctctggcagcgatggccgtataaaatgcccggtcatattccgtggcaatattgaacttgctcaggccgagatttacgctttccttaagctggtcatcaggtatatcggaacagccgtgaaggaccagaggcacctttaccgcgctgcggatcgcccggatccggtcaaaatccagccggggttctctgatatagactccatgggcgtttcccacggcgatagcaagggagccgcatcctgtcctctctgtgaaatcaacggcatcctctatggaagtataatttttttcattgacaatatcatccaggctggaaccgcttcccacgtgtccgagctccgcttccacgtccacaccgaacacctcggccactctcaccaccgcacgggtgagctccacattttcttcatagggcagtaccgaaccatccaccatgacggaaggaaagccgtccctgatccctcccaccgcgatttcatatgagggggaatgatccagatggaccgccacgggaacccgggccttctttgccatatccaccgcaaagtccgcgacatactttaacgcaatatgttccgcaaagccgggataaaattggatgataatgggaagccgttcttcctcggcggcttcaatagcccatttaactgtttcataattaaagacattaattgccggaaccccgtatttatgcccccatgcatgttccaggatttcctttacgcttacgattgccattttccctccattctgctgtactgacagcctcttccgggcggaatgcccggtgaatccttctctttccatcctcattatagatactttattttagtttgtaaacttcattaataaactaaatttatattctgtttttggtactttttactatatctgttttcttaaagggaatacaaaaaccggagaaggcctgctgccggaaaacagcagatcctttctccggttttctttatttttccttacaaatgcaagagatgtgtatactcatccttttttatacaggtaaccggaaggccgttgcaggatgcctcttccacagtctccactccatagagaattatctcctttacaggcattcccgtggttattctcagacacccgtttctcagctctgcggtgaaatgtcccttatacccatcgtcgtaaaaggtacaggaaagcctgtctttcaaattcatgcagacagtcaggtctttataaggttcttccagaccgcggcagtcatcagaagcaagcatggggactatggtattgggcctgatatatacgggaatctgatccagcgccggctgcagagaaatccaccttcctccttcgatctggcggccggtgaagaaatccgcccatgtcccctccggaagatatacggaaaactcgtcctggtcaaaaaccggagccaccagaaggctgtctcccagcatatattcatggcctatattccgcacattgcgatccccctggaactccagaagaagaggcctcatcatgggtacggattccagagaggcctgccatgctgcggaatacagatacggcgccagtctgtgacggagctgattgtaataagaaaaaatattcctggtttccggtgcaaaattccagggttccctgggtgttttcccatggcacctgctcagagaggaaaagaaaccgaattgtgtggaacggatatattcttcctcttcaggtacgcattcatagccttcatgatccgtattataaaagccgcccatgtcaaagccccaataggcaacgccgctcaaagcaatactgagccctccctgcaggatgcaggcatggttattcagatgggtggaggaatctccggcccaggctgccggaatggtatggcttcccgcataaccgcttcttccccagagcatgggacgttctcccaggggttcctttacctccttcatcgcctcatatatggttttcgcatacagataggtcagtttattgtgtccctgtaagccgtttgagccgtcataataaaccgcgttttccggaaccgcttcggaaaaatccgtttttaccgcgccgattcccattccaatcacttcttttaccctgggaacataccattccctgaaaccgggattggtaaaatcaaagcatcctaccttgcgatctgcagccgcggttgcatagaaggtcagaggattcccgttcccgtccttcaccagccatcccttctccccggccaggcggaagtattcggattcttctccgatataaggatatatccacaggcacaggtggatccggttttccagaagaaacgttatcatgccttccggatccggaaaacgcttcctgtcccatacccatgcgccgctgtcctccgatgcctgccacgcatccaggttaatcacatctatggcaatctcttcttcttttgccctctttactacctgtaccacttcctcctgatccttgtagacacatttggacatccacagcccaaaggcccacctgggtatcatgggtatgctgccggtcatgtttacataatccgccaggagatccttataatccctgtcggcaaacaggatataatccagggaactgtcatccacctccatgccgtaggtaacattggagccgcaccccatatcaaaggtcattctggtatagctgttcaccagaacggaataccctctgctgctcataaaatagggatggttcttataggaatcctccgtgttggtgctcagggcatctttctgccagcagtggattttctgccctcttttattgaattcggtgaacttttccccgaagccgtaaaaggcctcatcggaatacatgtacatgctctcccggacgcggatcacctttccttcttcgtcacagtcaaagccgatgggaagatacttgcacatattgtccacattggagtctctgatctgttccttcgtaagcagtctgccgtccagatatgtgcttacctcccagggtagtttttttatccggatttccatgcgcagagtgcggacggacaggtattcttccgtctcttccacctgatagggaactgtctgttccatggaaaaaacctcattggcagccgctggttcctttccataaggatacatctggaaacggtatgccgctgcacttacagggcggatgatcacctttgcggttttattccggtatgtacccgcttccacctccaccccgtctccccggtcggtatagccgaggacacctgtgaggaaatcaaaattatgggtgaatatcgttttcagataccccagctgcgggttatagctcacttctactttcttattcatcagataacctcccgaaatagttatagttggttccggtattcctccggagtacagccgcacagtttcttaaaagactgaataaaatgggacgtgttattatagcccacctgtgcggcgacatcattgattttcatggttttatccttcagcagctccctggccttcttaatacgaagctcgatgacatatcgggaaaacgtctgtcccacggcgcttttgaacagacggctgaggtaagacgaattcataaaatactttttttccgccagctcctgcagggaaagatcatactggtaattctgttccacgtaatgaaggatatcccgtattatggcatttcccccgtttttcagggaattttgctcctgatcgcagatttcacggataatatccatcaaatattcttccagctcttccggatgcttgaaaacatatagatcatatctgcgtgaaaacatgatttccaccttgcagtccatcgcctcattttcattgtataaagaacgataataccggttcacgctgcgcagaatgttcaatatcatgtcgtaataggcattcacgtctccgctttccaacatttcccgcttattcagcaggccgtgcaccagctcagccgcctttgcggcatcggaaagctgaagtgcgccggcaagggcattgtcatcccggggaaggaaataattgtttccgccatggggaagctggtattcaaatatcttattccagcctttcatcagacggatattcatggcgtacagacactctttatatgcatcataaatactcgccgttccataaaaaagccggctcatccctgcaaccactcccgtctcaagctgtacatggcagtaattcaggattccctccagatcacggaacagcgcgcttccttccgaatcctcctctgtcctgaccgccgccacatattcatcattcatctgacagaaaaaggtaccggcaagccggctgtccagtttctgggcacagattttgtccaggagccctgcatcccgggtattcattgtccgctccagctgtatgacgaatacccggcagggtgtttccccggacatcgccgcagcctgcggcatatggatctgcatcagttcttttttcgtgagcacctgcttggacgaggtatagccgttgggaagcttcttcagcctttccagcacgccggcctccacctcccggcggaagttttcctgtttttcctccagctgacggagaacgcgcagaagcagctcccttttgaccggcttgataatgtattgctttacctcgtattcgatagccttcctggcataatcaaattcttcataaccggatacaataaccacctgtatataaggcatgttcacatggatatattccgccagctccaggccgttcatccttggcatgataatgtctgtcagcaccacatccacatccgtattctgttccagaaaatccaccgcttccctgccgttttccacagcggaagccagctccgcctccatgtcacattccctgatgatctttatcagcctctgcctggcataatattcatcctcggcaatcagtattttcatattgtttctcccgcccggccggtctcaggctcctcgtcgcgcagcgcctttatcctcaggacagcccgggtccaccggccatattcgctatacagggtgattccgtattccttgccataataaccggacacacgggcatttacattaataatgccgattccgtccccgccgaaatcctttccggaattcatgtttaccctgtattcaaacagcttttggttcatttcctccagctgctttttgttaatccctattccgttgtccgaaaccgtaagaagcatgtctccctcttctgtaagcgctgcgctgattgttatctgccctccttccggcttatcaaacagtccatgggatatactgttctccaccagaggctgcagaatgaatttcatgaccttcatggaataaatttcttccggaatttcataaatcatctcaaactggtcagggaaacggtatttttgaatctgtacatagtcctttacatggccgatttcctcccggagcgtaacgatggagtcacccttcagattgtagcggaatatgttggaaatgctgtccgtaatttccacaatattttccatgttttctatttccgcaatagcgcttatggtattcagcgtattatatagaaaatgcgggttgatctggtaggtcagcattttgatctgcgcttccttctgctcaatttcatagagaagggttttcctggcatattcattgatacgttctgccatgctgttataattttgtatcacgttccggatttcattatttcccagcagccactcatcctccctggataaatacaccttttgaagggaagtgcctttattatgccggatcacttcatccattttagccaggggttccattatctgtttaatcctgtagtaatagatcataaagactaccgccgttgtgaccagaagcacggtaatatccctgattttgtgctccgttatggaacggagggcctctttctcagcaatgtagcgcaccaccgtccagcccgagctttcgctgcggatagcggtcatcagataatccagcccgtcgatccgaagaatatcctgttcatggccgtcatttaccatctgctttgctttttcctgcacctcggtaagctgttccccgtataatccgcctttcctgttgttgtaaatctgcatgtcctcaaaaaacagcagggtgccggcggggttatccgtggaattgaggaggcggtcaagctccgaatagccgatatccagtgtcacataggccagaggggaggttccgttatagctgtacagcaccttgacagccgttaccaccttataatccacctgaccgatgctccaaatctccggatccgtataaaaaatgctgcggcccagcttcccgctgtcaacaatcccccatatataatccttataatcctgaaaaacggagctgatattgctgtatacatctccgtttgccgaaaagatacagcagcgtttgatatatttactgttggaaaccacatgattgatggttccctccacataagtggtattctggaaacgggtcacctcatcatactggcttttgctgtggttgataatattgcacatcctctgatcctgatagtgcaggttgaacaggcttcccacatccaggataatggagtccacggaataggccagctgcttgctgctttccgtaagatgattgatgtcagcctgccgcagttcactgatattctggttatagatcataaggctcacgcccatgatgatgacgataaagatcaggaatatggtgagtacctccagacggacggattttcttctccgtcccttcacccatttttcgtaaatcccctgttttccagccatatctgctccttcctgcaatttccccggacggcaggcctttcaccaattctgtaaatctgctgcctcaggtttttaccgccccctgggtaagccctgcgacaatgtatttctgggcacaaatataggcaatgattaccggaagcattgcaaccagataagaggcgaaggccagattgtaatcaaaggtatattgtgatttaaagttatactggaacaggggcagggtccacatacccggctgctggttcagaatcagcaggggcatctggaaatcgttccatacccacagggcattcatgacaaagatggtcgctaccataggctttattaacggaaggactaccctccaataagcggaaaaggtggtacagccgtcaatagaggccgcttcctccagatcccggggaacgcttttcacataattggcaaggaggaagactccctgggaggaagcgagggagaggcacatacagatcagccctgtctggtttaaaagcttcattttagtcagatactgcaccagcggaaccatgataacctgaaaaggcacaaaaatccccaggagcagataaaaatagatagttttaaaatatttgttttcctccattttgcgggcgattgcataagcgcacatggggatgaaaaccagaatcagcacgacggatatgattgttattttggcagaattccacacatatgtccaatacccgcttttctcaaatacactgataaaattccccaggtaaaaggaggaagggagggagaagaaatcggcggcggattcctgctgtgtcttaagagaggttattatcgtgatatacatgggaaacaagataataaccgcgccgatgagcaggacaagccctgtaactactttcgcaattctggatgatattgattttcccatactaatcacctacctgtttattcttagtcatttttaaggtaacggcagccacaatggccacaataacaaacaagatcatggactcggctacggattggctgtaggcgttccctttcatcgcctggttgtaaatcaatatacctaccgcctgtgtggcgcctcccggccctccgttggtcattgccataatataatcgaaaatggtcagcccggccttcacctgggtgataataaccatattcagcaccggtatcaggaaggggaatgttatgcttttgaatttatcccaccggttggctccgtcaatggtcgccgcctcataaagctccgatggtacgctctggagccctgccaggaagaggacaatgggaatggagcagccctgccacaggtttacgatcagaatgccgaacatggcggtcgttttatttcccagaaggctgttggaaagccagcctatattcagcgccttgccgatgacgggcagggctctgtagaacagctcattccatatcagtcctaccgtaaccatggaaagcacggcgggaaggaaataaatggatcggaatattgtggatgtcttcgtgaggttattcaggcatattgccaccagcagggaaatgacaatcaggatcagcacgaacaggaaggtgtatacaaagttaaacttcagggcagcctggaatttacggtccatcagcgcttttatgtaatttccgataccgatgattttatacgacgcactgatgccgttccagtcggtaaagctgtaataaatgccgatagccatcgtaacggtaaaaaaaacagtatacatcaccacagacggcaaagtaaacaggaacagcgttctggttctttcggatattttcttttttttcttatccatagctctcttctccttacctgaaaacggacaggatatgcgcaccctgcccgtctttcttggacaaaagccggcccacagagtgtgggcagcctttgtttactgcctgtccccggacagactattgcaagttactgcgcttctgcctctcttgcggttttccagtcttcatccagctgggaaaggaaatcaggaacggaggttcccatgaatacattctggatttcagaacgcttggtatcttcaaatccggtaggaggtaccgccagatccaggacgcccgccttgtcaatcaggtcaagtacaagcttatcctggggaatatctgccgtcacgcctgtgattgcggaaggagaatgatccatatccgaatacatctgtcctgcttccgtggagaaaagataggccataaatttatccaccgcttctgattttgcaggatccgcggctgcctttgcgctgacacagatcgcgcagtcaacgcctaccggctgcttcatgtctccgctattgttgggcatggggaacatttccacattggcgtcgggattggctgcctggatagagggaagagcccagctgccctggataaacatgtaggctgctccggttgcaaaatcgttaatcgcctgatcatagccgagggacagcgtatccccctgggaatacttttcggttaacagaaccattttttccatggagtcattggcgattgcatctgcggcataagactggctgccatcgtccagaccggcgtaaaaatcagcatatccgcctctgtctttcccgccgatattgtcccaaagctgggaaacggtccaggaatccttattgggaaggaggaagggaacttcgcctttttccacgatcttatcacacagcgcgatcagttcgtcccaggtctggggaacggaaaagccggcttcggtgaatttatcaacattatagtaaacacccataaagttcagggaaataggcagacaataaatgcccccgtcttccattttcaaatcctcgatataagactgtacgatatttcctgtataatcttttcccgataagtcagccagaaggccttcattggcaaactgtacgaactgtgcgtctgtgggccagtgcataaggatgtccggcagtgtgtcactgttggctctggtcatgagcacgccgcttccgtcaggggtggtattcagcgttaccttgatatccgggttttgttcgctgaacttatcaatcactgcctggaaggtatctgcagcctccctcttctggtttacaaattcaatttccacagcgccggatgaagcccctgtatccgcagcctccttactttcggaagcctgtgcggccggtgtttccgccgcagcccctgtgctgtccgtggcagcctgttttccgcagcccatcattcctgctgcgagcatggaaattgccagcaatactgaaacagcttttttcttcatacctgatttcctccttttattaacagattttttctgcaggtacatagtaacattttatagcatgatgcctatataagatttatttcctaatcaatattactgtttttactttttttgaaaaatatccattatatactttgtatatattttaatatgttgtacagatttctatatacagatagtaatatatttgatatatctccaaaacgtcatatggtagcatgatatagagaattttatgtaactgtgaaggtactgaacatttacaaatttatttttaatcggggaggtttgcatatgaatttaggttgtatttatcacagaagccaggataatatgtgctacgctaaaaatgaatcggaactggtgatacaaatccagaccggaaaggaggtggatcgggttttcctgaattatgaagatcccatggagtcggaagaattcggcgggccctggacgtggaaggggcatcctgaggagatgctgcaggtaagggaactggaaaaccacaaatggtggactatatcggtttttcctccttataaacgctgcggttatttctttgagctcaggagcggggatgaaacctgttactatctggaggatggggtccgaacagacggttcctttatgacaggcaatgtaaggctgcagtatttttcttttccctggatgaatcctgcggatatcaatgtgacgccggattgggtgaaggataccgtatggtatcagatctttccggaacgcttctgtaataaaaaggcttctctgcccaaaaagaatattcttccctgggcggaggggagcgtgacaaatgatgagttttatggcggggatatcccgggaatcacatcgaaaatcggttatctggcagacctgggcattacgggtatctatctgacccctgtttttgaagcttccaccacccataaatacgataccacggactatcggaagatcgatcccgcttttggaacggaggaggatttccgtgaattagtggatacggcccataaagcgggtatacgaatcatgctggacggcgtattcaatcattgcggctattattttccctattggcaggacgttctggaaaaaggcccggaatccgcttactggaattggtttatggtaaataaatggccctttgatcaaacggatccctggacctacgacaaaaagtattattccttccatttcacggcttttatgccaaagctgaataccaataatgatgaggttgcggaatatctggcggaaacctgcgaatattggataaaagaattcggtattgacgggctgcggctggatgtggcccatgagatttcccataaattctgcaggacattgcggtcgcgtctgaaggccctgcgcccggacttttatatcctgggtgaaatctggcaggattccatgcgatggctgaggggggatgagtttgattctgtcatgaattatccctttcacaatgccgtcatgaatttcttccgggacaaagaaacggacagcaggaatttccagtaccggatcaacaaatgctacagcatgtacatggagcagaccaatcaggttcttttcaaccttctggattcccatgatacggcccgcctgaggaccaaacttccggatgaggattcctttttccaggccctgtgtatcctttataccatgcccggaagcccctgtatcttttatggaaccgagatcgccatggagggagggccggatccggactgccgcaggtgcatgccctgggatgccatcgaaagcggggcttatcaggaaacctgcgatatggtgaaggcgctcatccggctgcgcaggcaggagccgctctgccgctgtcccggtcttgttttctccgatccggaaccgaattcgcgggtgatcacttaccgcaggcaggaggataaccggtcacttaccgtatgcattaacgcaggcagcacctgcacagaggtaccggagggctgtgttcttttgtcacgcaggctggaaagcaggcagcttttgcccggcggctttgccgttatcaaataaaaatattctgccggagtaaaaaagttccggacaggcctataagcagcctgtccggaacttttttgaatgattatgtactgccgtcagatctcgattaattcatactgatcactgcccagcccgatctttactccatgctcgatacaggaatgccaattggtatccggtgcggaatcaatgaaatgatcatgatgcacatgaggcatacgatccagctggcttccgtcgataacaggctgcttatttacagcatccgcgcatgccacatccagagcaacgggatcgaaggaagcaaacattcccacatcgggtacgataggaatatcattttcagaatggcagtcacagttaggggaaacatccaccaccaggctgatatggaaatgaggacggccggaaaccacagccttgctgtattcggcaattttgcggttcaggatatcattactttcatccccgggagtgcataccgcatctttgggacacacaccgatacaacgtccgcagcccacacatttcttgtgatcaatggacgcttttccattggtaatggaaggcgcgtcatgggcacagattttaatacagcgtccgcagccgatacagttctcctgctccacatagggctttcctgcattgtgcatttccatcttaccggcacgggaaccgcagcccatgccgatgtttttcagcgctccgccgaaaccggtggcttcatggcccttgaaatggctgagtgtgatgaaaacatccgcatccataatagcgcgtcctattttcgcttcttttacatattcgccgccttctaccggtaccagttcttcatccgtaccctttaatccatcggcaatgattacatgacagcctgtggaaaagggagaaaagccattctggtatgccgcgtcaatatgatccagggcatttttccttcctcccacatacagcgtattgcagtccgtaaggaacggtttcccccccagttccttaataaccttaaccactacggcggcataattgggccttaaaaaggccagattccccggctcaccgaagtgcattttgatggcggcatatttatcggtaaaatcgatattgccaatacctgccgttttgatgagacgctccagcttctgaggaagattctcagaaaaggaagtcttcattgttgtgaaataaacctttgatttttccatgtcttttccctccttaaattattatcctaaatttcgcacagggccctgtcccctccggcccctgctttcggggcggctccccggtttggatttccttccctctgcgccagccatgcaggatttcctgtaaggggcgtataaactcgccggtccttaggccgcgttttttgcggccttaggaccgctgcgtgtttatacgagtgagagcgtcccctttaaggattcctgcatggctggcgcagagggaaggaaatccaaaccggggagccgccccgaaagcagaggccggaggggacaggggtctgtgcgaaatttaagttattatcctaatgctacgtctaaaatcatcataataaggaaacctcccataacccccagggtgcctacattggaatgctcccccagatgagcttcaggaatgagctcctccactaccacatacatcatggcgccggccgcaaagctgagaagccagggcataagcggctggattcctccggcaatcagaacaaccagaataccgaaaatcggttccacaattccggaaaggctgccgtaaacaaacgctttccaggaaggcatcccttcctgctttaaaggcagggatatcgccgctccttccgggaagttctggataccgattcccagggcaagagcgaacgctgccgccgcaccggcctcagcccccatgttctgcgccgccatggcaaacgccagccccactgccattccttccggaatgttatggagagtgaccgccataaccagcagagtcgttcttttccaggaggacgaaataccctccggttcatccgaacccgcgtggagatggggaagcagctgatccatcagcaaaagaaataaaataccgaggacaaatcctcccgccgcaggtatccaccccacacctcctgccgcctccgcttcgtcaatggcaggaatgagaagggaccatacggaagcggcaatcatgactcccgccgcgaatcccaggaaaaccctctgtattttcatatttattttgccgcggaataaaaataccatggcggcgcctaatgtggtcatcagaaatgtaaaaccggtcccgccggacgcccatattaatgcctgtttcatgcattacctcctttcaaaataaaatctgtgctctgtccgttatccatattatcagcccgtaacggacccgctatacctccggctgtccgaaaaagctttcccggtacatgccttatccgccgctccctgctttcagccggcgttttagatgcggggctgatataattcaccttttttatccttttcttccagaaattccagaacagcaaaaagactgtcgcatttccggtaaagcattttctctatttccggatcgggcttcaccagatccggcaccataacaggcagcatccctgccgcatatgcggatcgtattccgttgggagaatcctctatggctgccgcattgcccggttccacatcaagcagctgacaggccttcaggtaaatatcgggctggggcttgctgtgctccaccatgtccccgccgataaccgcctggaaaaatccggtaaacccggcctgctgcagatggctttccaccgttttatggcttgtggaggaggccagtgccacctttaaccctttttcctgcagccatgcaagaagctctcccgcgcctttcataacaggaaggccgtcctttgccatcttccgctgaaaaacggctgctgtctgttctctgaaataatcataggggaaatcctgaccataggtttcttttagaaaaatacggcagtccgtgcggttcaggccgatacagccatatactcccttatcaatatccggaagccccagccgctttgccacttcgatccagctttccacactgagcctttccgtatcgaacagaatgccgtccatatcaaaaacaatcgcttcaatcatgccggccctcccttatataaaaggctgccaagacgggcaaattgttccagggtgaaggtttccccgcgtatcgtggcaggcagtcccattttttccaatgcatccgtgacctcctccttcgtaagattcaggccggacgcattgctcagtccgttcacaagcgtttttctgcgctggttgaaggacgcacggatcagtttgaacataaattcttcatccgctgtttccaccgggggcttttcatatctgttaagacgaatgacggtgcttcccacattgggtctgggcatgaagcaggacggcgggacatgggtgacaatttccggcctggagtaatactgtaccgctagggaaagggcgccgtagtccttggttcccggccccacctgcatcctctccgcaacctcggtctgcaccatgatggtgatgctttccagagggacatggctttcaaacagctgcatgattatgggggtcgtgatgtaatagggaagattcgccaccaccttaaccggcttccctccgttcttttcccttaccagctcctccatatccagcttcaggatatctgcgttgataatcgtaacattggaataagccgacagggtatccttcagtatgggaatcaaagccttgtcgatttccacagctaccacttccccggcctgctctgccagatactgggtcatagtgccgatgcccggccctatttccagcacacagtcctcttctcctatttccgcggcctccactatggtttccagcactttgggttctatcaggaaattctgtccgaattttttctgaaaattaaaattatatttatgcagtacttcaattgttcctgtgggcgtacctaatcttggcatataaatcctccgtagattctagtcgattccataaaagcgtttcgcattccgaaaggttatttccgtcacttcctcttcggatatccctttcagagtcgcaatctgtgcagctacaaggggaaggttcagggaactgttgcgcgttcctctgtgaggctccggcgccaggtaagggcagtccgtttccagaagcagcctgtccatgggaacgtattccaccgtttccttcacctttcgggcatttttaaaagtgaccactccgcctattccaatcatatatcccaaatccaggaactgtctggcggtctcctttgcataggaaaaacagtgaatgacggcaggtctgtcctttccatattcttcacgcatcatatccagggtatcctttgccgcatccctggaatgaatgataaccggcctgccgatttcttttgccagggccatctgacggctgaatgcctctttctgtatatcccgggcaggctcgtcccaatagtaatccaggccgatttctcccacagcaactgctttgggatccgaaaaccggctgcggagccattcaaggcccgcatcatccagcgtatgagcatgctcgggatggattcccacggcagcatacaaaaacggatattctttcgtaagctcaagtcctctttcattggaatcgaagctggctcccgcgttcaccacgtaaccgatccctttttccggaaagcttcccaaaagctgttcccgatcttcatcaaaggctttatcatcgtaatgggcatgactgtcaaaaatcattataacacctcttacccctttctatcagcaaatctgtgaaaacaatagggatcatatcatattttttactattcttaaaggttgataaaaatttcttaaaatttttttaaaaaactattgcaaaatgaaaattaatataatataatgaatcctgcgttgcaaaagaaaatttaagcgcctttagctcagttggtagagcacctgactcttaatcagggtgtccagggttcgagcccctgaaggcgcactttgaaagtaccgattttgaagacatccagagcttcggggttggtgcttttttttgtgatttttctatttttatccgtttccatttacgtcagttctgtcttctctcttttcctcctgttttttgattactgtaatactttttcatatgtgctataatagcggtatcaggtaatattatttaaatgggaggtatttttatatgaaaagagcaagaaaaatatttgttctcatgctgtcgtgcattatgctttgcggaataacgcagccaattcaggcggcgtctcccgcttcccttgttactgtgcgtaccgatttcagcgatacatccgttccgtatgccgtaccggttcttcagtatgccggaacaggcgacacagttattccggatgtggtgcttcctgaaggatctgcttataaggtttcgctcacacatgatggaaacaggaattttattgttaagttttacaatggagacaagtcaaatcttcttgccaatacgattggtgtttttgcaggaacatcccttttggaaagaggaagcacagcggcacggaccggtatttttgaaataatcgccagcggcaactggactcttactgtgtcaactattacgaatatttcaacaaaatctttatcgggtacaggctataaggtctccgggcttttcattctgcccggcacgaacaccactgttaccatgaactataccggaaaaagcaattttatagtatatgcccattattccaatggaaaaagccagttgttagcaaatacgattggtgattattcaggacagaaagtattgcgtaacccggaaaataccacatgctatttagaggtcaaatcgagtggggcatggacggttgatttaggttacggagatgccgtctctgtggtgcctgatataaattaaatccggcataatcgtcagatcaagagaacgcattacgaaaattccttttttaaactaaaaaccggtccagggccataaaaagcctctgaaccggttttctttattatacttttctgacgggatgccggattatcgtctttaatttctccggcgcggtttttctgggatcattaaaatagatttcatgatgccttcttttttcatttatatcggttatatatccttccttttccagaaactccttcatctgcagtatggtgccgggctcgtcatcgtaagatccaaggtgcatgatctgggcgcaaagaccttcctccattatttccatatgggcacgggaaagatccagctccggattctttttatgcagcttttctttggcctgttccaggatcccttcattgacaaaggaagggaggccgatcatggaggtccagcagaaccgggtcttatccgtgatatggatcccgtcgaagccttctccgttttccatccaccacagcccttccagagggggaaccacataatcgaaatagcctaccggctgggttccgtccattttgctcatttttatggtataggacagtccgtacagaatcgccagcgcgtccttatattcctgagtggtattgggatttcctttcccgtccacgcaaagataagtcatgggagggacttccacgatcaccggctgggttttctgtaaataaatgtttttaaattccttcttaaaatcaaatttctgttctgccatcatttatcctttctgttcctgcatcggaatatccatttcccttacgggaatcatgagttccgtaacatagttagaggggtttccgcggaatataagtcccggtccctttctgtaaatctctcttgagggggatacgggctgaagattcctttcataggctgcatccagaagcgccttatatgcaaatcccagctcatcatagccgcctttatggatcgtacttatggttctgcagcccggcagcttacggcagctgattcctgacgcctgaaccataccctttaccggaacgcacagctccacatccgcatcttccctgtattcctcatcgtaatacaggctgaagggacagccgaaggacttatttcccgccgctttataaaggctgcctatatacttgcccacatcggaataggctccgcggaaacgggtggataccactatcatttcctctatttcctttatcacgatgtcgtattcctgcctgataatccctgcggcagatcctcccggcagggcttcttccagcttcttcaaaagcgccttttctccggcaatccgttccagtatctgcgcctgcttttctttcaggaaataggacaaatcctcttctcccccataattggaaataacatccctgatctccataatggagaaatccagtccgcgaagcagggctatcagcctcgccctttcataatcctgatcgttatacagcctgtagccgttcttatcccgctccgatgggcacaaaatcccctgttcctcataataacgaagcgcttttatggtcagactggttattttggaaaactctcctattttgtacaccggcggctcctcctttcctgttaaaagaagtataagccctcccctgcggggaagggtcaagcttttttttgtaacagcccggacaggtctgaacccttaccttttatcctttgttttctgtttttcacgatacatattccggtctgcttccttatacagggcatccacatctcttttttcggttccgagcagggcaaagccgcaggacagccggatgggtatttcatgatagtcgttataggccgataccatttcctccagaagcctcctgtattccttttcctgcagttttttatccttcaggattaccgtgaattcatccccgccgatacgaaaacattctcccctgccggcaaatgctttctttatgctgtctccggctcctataatcatttcatcccccatgctgtgtccataggtatcatttaccctcttcagcccatccaaatcaatcatggccattcccgccaattcagactcttcctctctggctctcaggatttccagggctttttcgaaagccgccctgttattgcaccccgtcatgatatccacataggccagggatctgtataccttgagctttgcccgttcctctcctgaaaggatgagctttctgaaggatatgactatcaaaatcaatgcgtacgccagcagcccaagccgcataattacgctgtaatccttcctgttactataaaaatcagctaaggataaaaatgccgttgccataaaaataaaaagggcaataaggatttccctcgcataaaacgaccggtttctccgacactccttacccagacagtaaatagtgaagataatggatgcagctatcagaatatgagtgatcggaagcattttatagaattccactcccgcagccatatataaaaatacctggataaaaaaattaaagctgaacaaaagctttaagacagacaatcccctgtatttcttttcacaaatactctccacaaagaaaaacatggggataggaaagaccataaagcataaaaaagagacgataaaaacaacctcggagctgcctgtcagcagctgcatgaccggtgaatccgaaagcacccacagcgaggacagcagtacaaacattccggcggaaagaaacatggagtattctgtatatccgctcctgatgcgcagaacaagtcccccggccagcaatcccattgaaaataccaccataagcacgccgaaaaaaataattccccagctctccctgaaaaatcccatcaggacggccccctggcttcccagccttatttcggagagcattatttttttacccacggtcctttcgatttgtattacagccgtttccgtaccgtcctggattcccaacgaaacaaagcattggatcgaaggaagaagactgccccgcagcggactgctgccgccatactgatagacgcatttctccccaacccggaccgtcaccttctgctgcctgttcctgaagctaagaaccaccggctcctccccggagtctggcagtttatggtaaaatatcatctcatccgcttccgcagtaaaaggcaattcctctacgtattttacctgcccgttttcctcataataccacccccggctgaaatcctccgtatttccgaagtcaactgcagtattctccaatccggattgattccccacgacaaaaaagacggccgcggcaaccacaaccatcaatccaatcaaaatatttatccgcttacgtacccgctttcccaactgttcctgcatccgaacccttatccctttcccaaaagaaaacccaattttctttatcgtatttcataagcccctccctgtcaatgaataccggctgaaagtgccaataaaaattctgatttggcaacacttattcaagagtgtctataaaaaacatcgttgccgcctctggcctgcgttaccctcccggctgtgtcccttgcctgtgtctgccccgctgcccctggtgtccttggtgccctccctttacggccgcagcacagcaaggattcctgtaaggggcgttataaacacgccggtccttaggctgcgtattttgcagccttagtaccgctgcgtgattatccgagcggaagcgtcccctgcaaggaaccttgctgtgctgcggccgtaaagggagggcaccaaggacaccagagccagcggggcagacacaggcaagggacacagccgggagggtaacgcaggccagaggcggcaacgatgttttttatctcccccactatgtagctcttgcgttccccacttcactatgctaaaataaagttccagagggtttcctatgaataaattacttatggaacagtttgaggactgtcctgtaatcgctgctgtaaaagatgaagaggggcttaaggcctgtattgattccgaaataggaatcgtatttgtcctcttcggagacatctgcagcatttcaggaattgtgaagaggctgaaggatgcggggaaaacggtaatcgtacatctggatttgatatccgggctgtccggaaaggaaatcgccgttacctttatccgcaataccacggatgccgacggcattatatccacaaaaccggctctcatccgacaggctaaggaatgtaatctctttaccgtgatgcgtttttttgccattgattccatggccttcgataatatccgcaggcagtcggaatccgtacatccggatatcatagaagttctgcccgggcttatgcccaaggtgatacggcgtatctgcacggaaagcagaatcccggtcattgccggcgggctgataacggatcgggaagatatcatggccgccctgaatgcaggcgccatatccatttcaacaacaaaccggcaggtctggttcatgtgaccgcttccggtttccttatataaccgaatattgtatttgcaggagaaaaagagacagcaaaaaggacgtaccgtcgggtatgtgttttttggctgtctttttcttataatatatgattttgttacctggcttacgccgcctgtgcggcagaatggaggaaaatatgctggatgtaattgtaatcggcgcgggtgttacaggctgtgccacggcaagggagctgtcccggtatgatttgaaggcggcggttctggaaagggaggaggatgtgtgctgcgggacctccaaggcaaacagcgccattatccatgccggttatgacgccgaaccggggactttaaaggcccgcatgaatgtgcagggcaaccggatgatggatgcgctttccaaagagctggactttccgtttaaaagaaatggttcccttgtcctgtgcttcgatgaggataatctccccggtctggaggagctgcgggaacgggccgaagcaaacggagtccctgatgtacgcatcgttgccggagatgaaataaaggctctggagcccaatctgtcacctgatgtaaaggccgttctctatgctcccacaggcggtattgtctgtccttttaaaatgacgattgccctggcggaaaattcttatgtgaacggcgtggatttccatttcaacacagaagttaccgacattaccaggacggctgagggttatctggtccataccgcaaagggtgactttgccgcccgctgtgttgtcaatgcggcaggcgtatacgcggatcagttcaacaatatggtcagcgcccataagctgcatatcactccccgtaaaggcgaatatatcctgatggataaaaaggctggggatttcgtgacccataccatcttccagcagcccacacggctgggcaaaggtatactggtcactcctaccgtacacggaaatctcctggctggccccactgcggaagacatcaccgataaggaagaggtgtgcacaaccggggaaggtcttgcccaggttgtggataaagcccggctgagcgcggaaaaaatccctctcaatatggcaatcacttcttttgcaggccttcgtgcctgtgaggaaaagggggattttgtcctgggcgaagcggaggatgcggagggcttttataacgcggcaggcatcgattctcccggactttccagcgctccggccatcgggcttttcctggcggagcagatcgcagggaagctgaatgccgttaagaaaaccggatttatttccgaacggaaggatatcccctgtgtcgcggaaagcacgccggaagaaatcgccgctctcatcgcctccgatccggcttatggcaatgtgatctgccgctgtgaaatggttacggagggcgagatagtaaatgctgtacgcaggcctttgggcgcgaaatccctggatggagtaaagcgccgcacccgcgcaggaatgggacgctgccagtccggcttctgttctcccagagtaatggaaatcctgtccagagagctgcaggtatctcccatggaactgactaaagcgggaggggagtcttatcttctcaccggcaccaccaaggaatttatataaagcatggaatatgcggaaaggtttactatggctgattatgatttgattattatcgggggagggccggcgggcctggctgccgcagtctccgcccgtaaaaacggcattgataaaatcctggttctggaacgggataacgagctgggcggcattctgaaccagtgtatccacaacggcttcggcctccatacctttcaggaggagctgacggggccggaatatgcagcccgttttattactcaggttaaggaattggaaattccctgcaagctgcacaccatggttctggatatttctcctgcttccgatgacgcttcggaaaaaacagtgacggcgatgaaccggaaggacggcttgatgacgctcactgccaaagccgtcatcctcgccatgggctgccgggaaaggccgagaggggcgctgaatatccctggctaccgtcctgcgggcatttattccgccggaacggcccagcgccttgtcaatatggacggatttatgccgggaaaggaaatcgtcatcctgggttccggtgacatcggccttatcatggcccggcgtatgaccctggaaggggcgaaggtcaaggtggttgcggagctgatgccctattccggcggcctgcagagaaatatcgtgcagtgtctggatgatttcggcattcccctgaagctcagtactactgtggtggatatccacggaaaggaaagagtagagggcgtgaccctggctaaggtggatgaaaagcggaaacccattccgggtacagaggaatatatcccctgtgacacgcttctgctttctgtgggactgatcccggaaaacgaactgtccggaaagctgggtgttgatatgtgtcccgtcacctccggccccgacgtgaatgaaagcctggaaaccagtatacccggcgtttttgcctgcggaaatgtgcttcatgtccatgatctggtggactatgtttcccaggaggcggaaaaagccggcaaatatgcggctctgtatatcaaaggagagatccgcaatccctccggagaggaaacagtacggctggttgctaaaaacggcgtgcgctatacggttccccagaacctgcatccttcccagatggaagacacgctcaccgtgcggttccgtgtaggcgatatttataagaactgttatatcggcatatatctggatgaccggcagatagcccgcatccggaaaaacaagctggcgcccggagaaatggaacaggtcattctcaaaaagaaggatgttctgtcccagatgggacattcccaaccggggcttaaaaccattacgatccaggtagaaagaggtgaagcaaatggaacagcgtgaactcatctgtattaactgccctttaggctgtgcccttaccgtcacgttggaagacaaggatgtggttaaggttaccggcaatacctgtccccggggagaggcctacgccagaaaggaatgcaccaaccccacccgtatcgtaacctccaccgtcagggtaaaaggcggccatctgcctgttgtttccgtaaaaacagcctccgatatccccaagggcaaaataggggaatgtgtgaaggcgctcagggatatctgcgtggaagcgcctgtacatatcggcgatattattttggaaaatgccgcggatacgggcgtaaatatcattgccaccaaggatgtgctctgatatagtaggtttacggtaactgtaaactttaatagaggaaaggatctgtgatgataaccgatttgaatggccgcaatgccgaaatactgaaaaagaaaaagctgtggctgctggacatggacggcaccatttataatgaaaacgaaatctttgaaggaaccctggatttgcttcagcaaatccgtgataacgggggaaggtatattttcattaccaataattcctccaaatccgtaacggattatgtgcagaaggtaacgggcatgggcattcaggcgggtttcgaagatttctacacctccagccaggctaccgccatgtatatcagggaaaattatcccgaccagacggtatattgcatgggaacccggtctttggtaacggagcttcgggaaagcgggctttctgtggttacagagccggatgagagtgcttctgtcgtactcatcggttttgatacggaaaacacctcggaaaagatccggaatacctgtattatgctgggacgggatgtggtttatcttgccaccaacccggatctggtctgtccggtaagcttcggctttatccctgactgcggatccatgagtatcatgctgaaaaatgcaaccggcaaagagcccttctttatcggaaagccgcagcctattatggtggactgtgtgctgaaaaatacaggctgttcagccggggaagccgtcattgtgggagatcggctgtatactgacatcgctaccggcaaaaatgcgggcgtggatgccatttgtgtgctttccggcgaagctactctgaaagatattgaagacggagatatcaaaccggatttcctgttccgggatgtaaaggaaatctggcagaagcttcggtaagctccggggtttccgatgtgtcggtttccgcacaaaaaaagtgcagcccgcatggattgctatcttatccacagcggttctgcactttttcatgtttatccacaatttcaggaaaatctttttttgatttcctcatatttctcagccgtaatcagcgcgtccctgtccaaatccttaaaggcaactatataggtccagcgcccgtagggttctatctttttgattttggacagattgataatataggatttatggcttcttaagaacagctccggatccagcttcgcctcgatatccccaagccccgccgaggtggtaaaggaatcctgtctggtgtaaatgacggtgctgttgttttcccgctgtaccaggacgatatcctggatatccacaaaactcatgctttccctgccttttacaagaaggcggtccagtcctttttcatagcgcacgattttatccggatgctcctgcggctcctgctccttcagggaaaggatacgggccagagtacgatccactctttcgatatcaaaaggctttaccagatagtcgaaggcgtaaacctcaaaggcttccggcatatactccgcatgggcggtggcaaagacaattttggtctttggctccatgtccgcaatgattttggcgcagtcaatgccgctggccccattgatttcaatatcaaggaagaccacctccggcttcagcctggcgaaaagactcaccgcatccgccaggttatcgcattccccggccacttcaaagccatcgttgcgctctatgatttttctaagaagcttccttattccgctttcatcctctactacgattaccctgattgccatatgctttcctttttctttttctgcagaccggttcgccgataatttcgcttaatactaccgctttcctgagaaccgtccgtcgctgtgacacagcctccggacgaggaattctatcccggctctccccttttgttcctgccgctgttcccggcaatgccccgggtgcctgctgttcctgccatgttttctgtacggcagggtctgaggattcttcctccggggagaaaatctccgaagcctcttcctccgggagtgatacccccgggggaaaataaggattccacgcaaacctgctgcctgccgatttattggacataagcacgccggacagccttccaagctcttcctgcaaacttctctttttcattgcctaatcattccttccgtcgccggtcaaatccgaatcaacgattcctgttccggaaatagacgaacgcatatcggtatccgctttcagattctgaagttcataataatccatcacgcccatttttccttcacgcagggcataggcaagggctttgggaacttccgcctccgcttccaccacgtacgcacgcatttcctgttcctttgcaacagccatggcgcgtctttcctccgccttggcctgggcgatatttttatccgcttccgcctgcagggactggagatgggcgccgatgttgcggcccacgtcaatatctgcgatatcaatggaaaggatttcaaaagccgtaccggaatccagacccttgcttaacacacgttttgaaatgtcatccgggttttccagcacttctttatgggatttggcagaacccacggtggttacgataccttcaccgattcttgccaggattgtggcttctccggcgccgcccaccaggcgttccagatcggctctcacggtaactctggccttaaccagaagctcgataccatcctttgccaccgccgatacattggtggtttcgattaccttgggatttacgctcatctttactgcttccagaacgtcacggcccgccaggtcgatggcagccgctttttcaaaaggaagctcgattcccgctcgttccgacgcgatcagggcattgaccacattatccacatttccgcctgccagatagtgtgcttccagctggtttactcccagatccagtccagccttcctcgctttgataagaggaatgacgatacgggaaggaaccacgcggcgcagcttcattcctatcaggttgaagatactgattttaacatttgcggccagggaggatatccacagacctataggtacaaaaataaaaaacaggacaataagcagtccgatgataccgataatgctgattactattatattactcattacaaagccccctttactattgttcctttacaattaatttggaaccgtttacctttatgatttccaggttcgttccttttgatatatattttccttccgaaatcacatcaaaattaacgccctcaaaatttcctactcccgtgggtcttaaatcagtctccgcaattcccttttttcccagaagataatccagatccgtggagctgatatagccctcatccttcttctgctcttcctccagaataatcggtgagtgaatcttgcctttggacagcagccacacaatgaccgccatcataattcccagaagcgccagcacaataacggtaatgaacgctccttccgccacggaatccgcagtcaggaaaactcctgcaataagacaggcgattccgctgatccccggcgctccgaacccgggaattaccatttctatggcaatcaaaataaagcctgcaatgaaaaggataattcccaatatcatcaatgtatccattcctttattcctcctttccggcaccggatttacgtctgctgtaaaagaatatcccgtaccgccctttctatgtctgattatagccgtttcctcatttcaggaaagtggtattccgcaacttatacaaaacgggggctgtaatgtcaatatcctgctttcaaatgcatgcacagatattgcttcctgttacatgaaaaacagggtgcagataaacagcatttacctgggcaggcggatcgcaaagcgggtctctttttcatcggagaaaaggctgatttctcctttggcttctttaacgatctgggaaacaatggcaagtccggtaccgtggccttcttcttttttggtggaaaaaccctgcttaaaaatgagagcctgatgctcttcgggaatagcgggcccgttattgcggacggcaaaggtatagaatctgctgtcctggcggatttccaccgccagctttttttctccctctttttcttccagggctgtaatcccgttatcgatgagattggcgagaagcttgcacagctcccacggctccagcgggatctccttcaaaggcgttcccacctccacaatcatatcgactccctttttctccgcagattccattttggcctgaagcagggcgtttaccgcgggctgggaggttttcatggctctcgtcaccctggtgatatccttgaataccggctccatatattccctggcgtcctcatattcccccagctccagcaatccgtagatcacctgcaggtggttcatataatcatgtctctgggcgcgcagcttcagattcaggttctccaggttcttcatactctcccgatagctgtcattctggtacctgctggccatatataagcccataatggtgagaaggctgcttaacagcatgatacctatcgtaagataaatagcgggattcaccctgcccagcacctgggagcctatgaccagccagagaagaaaggccgccacaaactgaagtccgttgattatgaggagtgccttaactgtttttttaatattcatgtcctattccctcattggattcttgccagatattctttcgacagaattttctttatatttatacaaaacagtattcccgctgtagccgcagaaataatatcggatatgggttccgcataataaatccccatcactccaaagaaccggggaagcacaagcgccaggggcaccaggaggatcacctttcggaacatggcgataaacagggatattttggcctgtcccagagcgaggaaggtgggctggatcccgttctgcaggccgaaaaacagcattccgaaaagaaataccggcatgaccttcgataccaggccgatcaattccctgtcgttcgtaaacagggcggcataggctccgggaaatatcatggcggtcaggttggcggtaaaggaaatggcaaagctgattcctatcatgctccgatatagttttttaacccgatcaaaattgcctgcgccgtaattatagctgatgatcggctgcactccctgggtaaatccggagagcggagcggaaaagagctgaagcacactctgcatgattgtcagggaacctacgtacaaatctcctccgtatatctgcagtccccggttgagcacaatactgatcaggctttccgtggatcgcatgataaagggggaaatacccagggaacaaatctgccacataatgcggaaggagggacgcacatggcacagagacaggcggagggaggatttcgggctcataaggaattttacgttccaggccgcgcttaccgcctgggaaagcacagttgctatggccgcgcccttcactccccagccaaatacaaaaataaacagaggatccagggctatatttaccaccgctcctatcacgatggatatcatggcgatccgggagcggccctgggaaataataaagggattcagcccgagggccagctccacaaacagggttcccagcagatatatgtacatgtaatccatggcatagccgatggtggcatccgatgcgccgaacatatataggaacggccggagaaaaccatagaaaacggccatgagaagcacggtgaaaataacaagcagacaggttccgctgccgagtattctttccgcgtgcttcctgtccccttttcccagccagatcgccgcaagcggcgctccgcccatccctacgaaggctgaaaatgcggaaatcagggtaatgatgggaaaagtaatgccgacgccggtaagcgccgccgcacccacaccggggatatgtccgatataaattcggtctacaatattataaagtatattaattatctgtgcgataatggatggaaccgccatactcaccattaacttcggtatgctttccgtacccatcttctgttcgcctttttgattcattggtatccatcctccggcttttttgagaacatgctccggactgacgaaacatattcctcttttgttttccagtatatcatgctttttattaaaataaaatgagggaaggactggccttacctacgtaaaagtggtaatcttgtatcagacataacagacatcatgcgtaaaggagattcactgatgaaggattatacagagtatattgtggagcagacacagaaactgctttccattgacagccctacaggctataccaaaaatgtggcggcttatctgatgaaggtctataccgaactggggtatgaacctgagcttaccaccaaaggcggcgtatttgtcaaaatagcggacggcgtatcggaagacagggaaaaatgcgatcccgctgccggcccgattctcatggaagcccatgtggatacactgggggcaatggtatcggaaatcacctccgcggggcacctgaacctgaccccgttagggggcatgaatcctaataatgcggaagcagaaaactgccgcatcgttacgagaagcggaaacgtatatacaggtaccttccagcttcgcaatgcttccatccatgtaaacggggaatataacaataccaagagagcttactcggaaatggaagtcctcctggatgaagtggtacgcaccaaagaggacgtgcttgccctcggtattctgcccggcgatattgtctgctttgaaccccgcacagtggtgactccttccggatttatcaagagccgttttctggatgacaagctgagtacgggagttctgctgggctatgccaaatatgtaaaggatgaaaatatcactcctgcccgcaggatttaccatcatattaccgtgttcgaagaagtggggcacggcggctgcgcttccattccgcaggatgtaatggaggttctttccgtggatatgggctgcgtgggagaaggactgggctgtgatgaatatcaggtttccatctgtgccagtgacagcagagggccttatcattatgatgtggtaagcgcgctcattgaagcggcgaaaaaggccggcgcggactttgcggtggatgtatatcctttttacggttccgatgcggacgcggctctcaccgccggttatgatgtacgccacgggctgatcggccccggtgtatatgcctcccacggttatgagcggagccataagaagggcgtagagaatactttcaggctgctgaaggcttaccttggctgaagcccatacgaaaacggaggtttttatggattttctgcaaaagatgataccggtaaccgcccttatactgatagtgctgtttgtcctgatcctgattttccgcaggctcgcctacaggcgtaccgccacctttaaatgtcctgcctgcggacaggtcttcaggcctaccttaatgcagctgattttttccgtagggagccggaaggggcagatcctatattgtcccaactgcggggaaaagaattatctggaacaattggagaacgaaacaccggaaaacgacgagaatgctgctcagaaatgagcagcattcttgttactatcggtgtatattctttttacaggaacgttatcccatgcttccccagtcccccaaaggcgccgggtttatggataaatatttatcggatacggatattacaggggcggcctggcggaggcgtttttcaaagtcggcatcaccggccagatactcctcagccatcacatttttgatcgtgcaaatgtatatttcactctcctttttgtcatccagatgcagggttttatcaacctgaagctccaacgtccacgggctggctttcggcaccggcacattcaggaccccgcctttttcagattccactttctccgacttatcgaactcatatccgggatgggttccgcagaaatccgcggcgggcagaagcgcttcgctcactacggaagcggaaaatacgccctcagcccttattctgtcacgggtcagcttatcctgcccgatacaggccacaaatttaagcccttcatcccagcaataggttgcccagcagaacagcccgtaattgggttccccgttttctttgtatgtaccatacagatacaggcactggggacagaaatcattggatcctgacatggaaacttttgacatagtccgttcctccttatttttttgtcatgtgaataacgcagcagccatccgtttattcaaaacggtacagcatttcccaatggaactgatcttcatccagcctgtattggggcagaagctcaggcccgcaggaattggagcctacgccgctttgtttgtaatcggtgcatacaatgactgagcctgacggttccagttcatagttatgatgctttgcttccagctcctgtatggtatattccgaagcactgaagctgaagggcctgctgccggacgcctgcagccctcccacctgaatggaggagcagctgtaatggcttccgttttcctgaggacgcacatagtccacatgaagctggggcactgtggtatggaatacatcaacatagcttgcctgatgcttatcgcagtagctttcatgaggtccgtatcccagataggttacctcctgttcttcctgaggaagctggaatttcaggccaaaccggggaaggaacgggaaggatgtgtctcttttcccatccaccgcgaccttgatttccccttcgccgtttatgctccataccgcatgaagccgcaggaaaggctgaatataaacagccgctatggaaaaatcacaggttatggcaaccgtgccctgtttcaccctggcctcacagccgtatacctttactacacttctgtcatatccggcctctttccaggaatggacgatattacggtcattatccgtgggggcacggtaaacattccattctacgggagctgttatacaggcttttccgtttttctccagcttcaggaagcttccctgctttttcccgaattcatagcatacggagctgttttccatccggaaaacctccggggtttccgtgagagtaagaggctcgccgttcttctgcagtgtcagcctgacatccttctcttcggaaagtacaaactgatcaaagcccagctcatggccgatctgggtaagcttatcctttgccttctgataataggtcagcttcagatagcagtgatccttgggttttcccggaagcttcagggtaatgtcggtgaagccgtgaggggctgcctccagatcctctatcattccttcttccaggaggattccctcctctttgatttcataacggatatagatatagtcttttaaatttctgaaatccagcttgttgtaaaggcggataacaccctttttccgatccagcagctcggcccttaccggacggatcgcatttttccattcgtaaagcccttcgtgaggccttctgtcaggaaatacgaggccgtccatgcagaagtttccgtcatggggaaactctcccgcatcgccgccgtaatggaacatttcctttccgttttccgctctgccttcataggtggcatggtcacaccactcccacacaaacccgccgcagaatccgtcataacggtatatctgctgcatatagtcttcaatatccccggggccgttacccatggcgtgtatgaattcacactggatgaagggctttttctctcccggcttcgcaaaatattcatcgatatgctgcgtggatgcgtacatatggctttccacatccagcatggattcatctttttcgtgcccttcaggctggaaatgaacgctttcataatgaagcagcctggtgggatcataattttttacccagcgtcccgcctcttccatattggttccgaagccggattcgttgccgagggaccagaaaatgacgccgcactggtttttatcacggatcacgctgcgctgcactctgtccaggatggccattttataggaaggatcctgaacgaaatagctgaaggttccttcggtgctgcctccgtaaatggtggccgccccatgggattcaatatccgcttccgcaatcatataaaaaccatattcgctgcacagctccgggaaccagggtgcattgggataatggctggtgcggatggcattgatattggcctccttcatgatgcgcagatcaaacatggcatccatccgggaaaccacggccccggtatacgggctgctgtcatgccggtttacccctttgaatttgacaggcctgttgttgatgagcaccacgccgtctttgatgtcgactgtacggatgcccaccctctggatcaggatttcatccggggtctttattttcagtatgtactgataaggctcttccgcattccacaggacaggagcctccaccgggaaggacgcttttccgtcttcaacggcgcattcccccagaagggtgtctttatcccataattcacaggtaatccggggatttcccgccgcctcattgatcctcacttccacttccgccctgttttcatcaaaattaacaggtgtggtaacagtataatccctgacatgttctgcgggtctgaaaagcagatgcacatcacggaaaataccggacatacggaacttatcctgatcctccagatagcttccgtcgcaccatttcagcaccagaaccgccagcttattcattccggttttggttttccctgtgatgtgaaactcactggggctgtgggaaacctggctgtagccgacaaactttccgtttatccacacataaaagcaggaatccactccctcaaaataaaggtactgttcctttttagcctccgcagcactgatatcaaaatatttgatataggcgccgcagggattctcgtcgggtacaaaaggcggatcgaagggaaaaggataccttatattggtatattgtttttgatcaaagccaagcatctgccagcaggaaggcacctccagcctgccgaaggcctcttcgtcaaaatcctttttgtaaaattccggcacagactccacattgggataatagccgaatttccagtcgatcccgcttaagtttctagcgttctccttttcctgcacatcaagaggaacataataacacctgttctcttctgtcccgacatgcagtatttccgggttttcatagaatttttccagaatcataagctctcctttggaacaaacgttccatctcctctttttgagattatacttttggtacgccccatattctgtcagggttcccgtgcctgcccgccctttgctccgcgcctcctgcctgccctgtttgccttcccctcaggctatccctccccgggcgggtatgtgtaccctgcgcaggcacgttttcactctgccaaaaacgcagcggtactaagattgcagaggacgcaatctaaggaccggcgtttttcgaaggcctttgcagggtacacatacccgccggggaggaacgcctgaggggaaggcaaacagggcaggcagaaggcgcggagcaaagggcgggcaggcacgggaaccctgacagaatatggggaggggccgaaccttcattgctactgtaaattataaagaaaatatgttacacttacaatacaaaaaaggaagaataatcagaaaagcctcaaaaatttgttatgggcatgatagtttgggtgataacgaaaaagcggcggaatgtgaggaaatatgtacgatactcttgttacattaaaaaaagggaccgggaggactttgaaatccggggggatgtgggtttatgataatgaaatagaaagtattgccggtgattttgaaaatggggatttggttacggttcatgattttgacgggtattttctggggattgggtttattaatatgcaatcgaagattacggtgaggcttctttcccggaaaaaggggacggtaatcgatgaagcttttctggagaagcgggtggaaaatgcgtgggagtatcggaagcagacggtggataccgggtgctgcagggtgatattcggggaggcggactggcttcccgggctggtggtggataagttttcggatgtgcttgtggtggagtccctggcgctgggaattgacaggcttaaggctgtgattctggatgctctctgccggatactgcaaagggacgggattgaggtacggggaatttatgagcgaagtgatgccaaggtacggctgcaggaggggatggagcgttttaagggatttatcagcgctccttttgatacgaaggtacagattgaagaaaatggggttaagtatatcgtagatatagaggatgggcagaaaacagggtttttcctggatcagaagtataaccgggcggctgttcagcggctgtgcagggggaaaaaggttctggattgttttactcataccgggtcttttgctttaaatgccggaattgcaggggcggaaagtgttctcggggtggattcttcccagacggggattttgcaggctgaggaaaatgcgaggctgaacgggctggaggatcgggttcattttcaatgtgccgatgtctttgagcttcttccctggctggagggacagggagaaaaatttgatgtggttatcctggatcctcctgcctttaccaagtccagaaattccattaagaatgcggttaaggggtatcgtgaaatcaacctgaggggcatgaagcttgtggaaaacggcggttttctggttacctgttcctgttctcattttatggatccggagcttttttccaaaacgatcagggaggccgctgccggttcccataagaggcttcgtcaggtggaattccgcacgcagtgctgtgatcatcctatactctgggcggcggatgaatcctattatctgaaattttatattttccaggtatgtgaggaactgtaggtatcaggaatggttcctggttatctgaactgttaccggctttcataattcgtgcgaggaagggaaatatctcttatgtaccagacgatacttcatgattttgatatgcgtatgctgatggattcgggacaggtgttccggatctgctgctgcggggaaaatacatatgcggttgcatccggccgtcatctggtccggatacggcagacagcctgcgggccttcaaaggaagggactctgtcggctttcggaatgtccggggaaggggtttctgtggagttttcctgttccccgcaggaatttgattcctattggcataattatttcgatctttccactgattatggggcgatgaaaaaagcggtggatccgaaagacagctttttgacgtctgcgatttcctatgggggaggaatacgtattcttcggcaggatctgtgggaaaccatcctttgtttcctgatatcccagaataataatattacccgtatccgcaatagtgtggatgccctgtgccgccggtatggggagcggctggagccggaaggctttctgaccggtgaggagtctttgtccgaaaaggatttttactcctttcccgaaccggaaaaaattgccgccggaggtctggaagggctgcaggggctggggcttggctatcgggacaaatatattctcgccatggccaaacggtgctgcaacggcagcggaaaagaattcttccattccctgcagaatgcggattatgaagaggctattgctattcttaccggggaatttgggattgggcgcaaggtagccgactgcatctgcctgtttgccttacatcatatcggcgcttttccagtggatacgcatgtaaagcagattctggccgcctattacccgaagggtttccctttcgaacgctatcagggcttcgcgggggtaatccagcaatatatgttttattataagctgtcacttccgtcttcccggacaaaaaaagaagcggttaagcccgctcctgccaggaaaaaaataagctaagggaggtttctatggataaaactgattccaccattctttctatattaaaagaaaacagccgggcaagcgcttccgacatcagcaaacaggtctctctgtccgtacctgctgtgacggaacgtatccggaagctggagcagacaggggtgattgaaaaatataccatccgtgtgaatcccggcgcttccggctataaccttctggcttttatccttgtaaaaatggattattccaggaatatggaggcttttcaggatgtctgcctgcagcttccccaggtgctggaatgccatcataccgcggggcctgcggattttctattaaaggtgcttttccgggatatgcaggatatcgaggattttctgtcctgtactctgaaggatatcaagggcgtgaccgatgccaatactatcatctgcctgtctacgttaaaggaagaaattacagtttaggctgggaaaaagggcagacttttatcctgcgtcagtttcttttcatagatcggattatctttttggattctgcggaaacgctgtgtgattcggtgattttctgaagggatttgttgtaggtaaaatcgtccaggcggttgttctgcagatagatggtggtttgggcggggaatcggacatagcacatggaaatggcccaggcgagcgccattttgacgtaatatccctggtgggtgatgcggtcaaagagcgggaaaaggctgtctatatattcatcattgatgtagtagtcgagaagcatgacgagaacaaagcggagggtgaattcttcctgactgttcaggaggggctggaaaaaatcccagaattcggatgggtattgtgcggcaattttcagtgtgatgcagaagctgtcacaaacggaccagttgtttatccttggaaggaattgtgtaatctggtcaagaatgacgggaaggggtgcttttgcatagccaatcaggaagccccggagcatgatttcttcgaagctgtcctgggtgcagagatttaggttctgcagccagttttctttggctaaccttttggcaagcctgcggagggcgggcagtctcactccgagtatattttccgtgccgggaagcagggaggatgcaaaatccctgtaggcaggttctgccagcagggataattgttctttgatggtgttattgtttttcccggaagaaatcggcataatcttttccttctttgatgtaaatttctgcatttctgcagttgctttccacttcccgctccagaacctggcgttttacggatgccgggcttccgatgaccatggaattatccggaacgatggtgttctgggtaaccagcgctcctgcgcctataatgcagtttttaccgatgactgctccgtttaaaaggatagcccccatgcctatgagggtattgtcaccgatacggcagccgtggatgatggccccatgtccgactgttacctggttgccgatggttacgggatgccctttatccacatggactactgagttatcctgtatattggtgccttccccgatccggacagaggcatcctccgcgcgtatgaccgtatggaaccatatgctgcagtcttctcctatatgtacgtcacccagtattaccgcgtccggcgcaacgaatacgctctctgcaatctccggtgttttcattttatccgtcccttcctttagccaatcgtaacgttgagttcccgaaagccggggaaaaccccgggttcaggtttattatgccattccttacccggggagtcaattacaatataaggatctgccaaagaagatattttacagagtatcctgcaaagttatgagaccgcagggttccagaattccctgtgaatagtgaagagccttcagttcaaagggatctaattccaccattatctctctttctataaaagtaaaccttgttttccgaggctgtgatgaactattgtataaatgtatcagatatcctgcgtccgtcctctttaaacataacagctgtatctgttcttcatcgatttttatatttcctccggctgtgggcttgctggcattagtaaaataagaacgggcaaaaggtgcttcattatatactgccgcttctttatctgccgtgttcaactgacactcccgctcccctccatgaatagaaaacagaaatgaccgttctcctatatctatacgggatagaaatctatcctggggaagaattatcctgtcatcaataggatgagcagtataggcaggcgaacgcagcagagtgagacgcagttccccattttcaaagctgctgccgtagcttccctggtttaatatggtcaggcccagtttatcattacatacggaaatccacttttgtgaaacattttccgtgccattttcatataaacgggctctgccaagcattttttgtccccagcattccgcatccttccagggagtcggaagagacagcttaaccatatgattgggttcgttccactgcaggtgtatctccaaatccagcttattagtaatcggttgaaatttataatggactatggcagccgaacgtttataaaggaagattgcttcaaccactgttctaacggggccatgttcgattatatgtacaggatctattgccttatccaaaccacagattttacccgcctgttctggagatgcaggcgtaaattcaccgatgatttcagggaagctgtttactgtcatgccccagggatcctcattgtccgcaataactaccagacgggcagctcccgggcagaaaagggagattccgtcaatcctgtaggaactgattagccctgactttttatcaattatcagctctcctccggagccttccagccggatctcagattcgattgtctgaggtaattccggtttcccggtaagcacctttggataggcgtacaaggctgctgtggcaaacggagggatatcagccatgaatacaaggcgtttccgccagtccaacggtatggagcttccctctttttccagctgcgacgggattacttccccttgatatctcacctcgaaatcagtataggtataatcccatccctgatcctgaagctggaattcacactccagaaccgccttcacaggccatggatgcggattgcatgcaaatatgggaatgacaccaggctccagcttttcagtctggcggcagaggtgcataaacgcccgggttttctctttttccagaagggaaatcgcgcctcccatttctcttaacgccgcatcttctgcccgttggacggaagtgcccggaaggatatcatgaaattcgttaaacaaaagaatctcttcagcctgtttcagcgattcccaatccccttccataccggtaaagatttctgcggccgccagaagcttttctgtctgatacagcatgttttcaagaagacaatgtgtttgcttgatacggacctgtgaggtgtagcagccgggcatggagggacctatttccctgtcaaacaggggcagctctgatccggaaatggaatcaaaatacatttcaggagtgctgtgtattaactggacgccttctttttcccactctttctgaaggagtgatatttcatccagatcttccttagacggtccacccccgtgattcccaattccccataatgccagtacagaattatctgttccttcctgcctgcggtaatattccagttttctgcggactttgccaagtccgctgttgtagccttccgctgccagatgaaccggtatacaggtgccgtcatatccttcccacagaaaatccggtccgggagccttgcacacttccaaagatgggcgtcccaccagataggaggtatatccgcttttgcgaagaagctgtaccagtccgcggtcatgtccgaaggaatccacatttatagctgtacgggggcggcacccaaacttttctctgaaatagttcagccccttttccatctgtctgaaaattgattctccgctgctcatcacacagtccggctgcagataccagccccccatgatatgccattttcctttttgcacaagatcctgtatcttttgaaacagaggcggatcatattcctcaatccactggtacagctttgcttcattatggttgaaaataaatccgtcataggtttcacaaaatgcggcggctatacggaaggtggacagcgcctctgccaggctttcatgccactcccactgccacaccagatcaagatgtgcattacatactaaatataacgttttattgtctctcatttactatctccattccgaacctgccggagattccttcagatataattccgcataggcattggcatccttacatatttccgcagcagcgtccggagccttttccagagttccgtccacaatcgttatcgtggggataattcctttgcgcagcgggcatttttttatcggattgtatcccagttcatggactccggtacttccccgggaaacatcgcccagacataaatggccgaagccgcgggcataggtgtcaaacatgggggcataggcctcgtcatgccagtggaaaacgccgtccgtatgaccgcactgcagaagcggaatgcaggcggtaagaccgtcataccagccttcgccggccaggagcatatcgggattatattttttgaatctttccataagctgtttcacgccgtcatacaggtagtggctgggatcattcatccataccgccgcaatatcaaaaaaggcggcgtcaaacccgaattcctccattaagccggtgacctgtccgtagagacggttctgccaccggggcgcggcgggattcagattacggttggaattatggtcataatggcgggagccgtcccaatccacactgcctccgtactggctgcctcccggccctctgaattcggaaggaatcccccattcctcatagttttcgaaatggctgcccaccacatttatcccgaacatgggcatgacatggactcccagctccttcgcgccgtcacatagcttccggaagccttcttttcctcccatccgttcgtcagggacataattcccatatttccagtaataacggccttcccaccccggaaggtaggcgagcacgcgttttccttccacctgcctgcaaatttttttcaggttttccaatacctgttcatagtcattgaaaatatatccggtccagtgctggcagtgtatggaggccaccagggaaatttctcttgcccagccggggacgtccgttctttcctcccatggcacaagtccgtagcacttctccacgtgcagtctgtgaggctcataaatctccgcaaggtttttcccccatccgatttcccattccggagcatcaatccggttcgtcattgaaactgccgcttcttcaaaaataagctctgcattcagtttatctccggtacgtacgaagacaaagcgtttgtctcttaccttttcatccagggaacggaaataaaacatctcattctccggtgtctgcatgaccactaggggggtgcctacatcccgccagccctccggatatttcaggttcaggccttcctgcgggatttcacggggctgcgcattaattaaattaaccagctttccatccgggatcccgtgaacaatgactttaatacagcggatatcttctccgggattctgtatttctgctgtggttttcacccggatgccatggctgcagatgcaggccctgacttcaaaacggcccggcatttccatctggccgcctgcccaccgcaggcccttgccctcggcccaaagcgtatctccgggctgttcgacggtcatctgcgcctcatcgggcgcatacacattcctgaaggtataaatcaggacggaaaactcaaatcctcccagttggaaatgaggggttggaaaagaaaaacttaaatcctgcataatctgtttcctttctttttaccgttcagtgctttgtccacctgtaattctttttacgcagcttctccgaggtttgttcttccgtgacggacagctcctgttttccttcttcccaaatcagcttcaccagagaatattctccctcttcataagcatagctggccccgtcatccgagtacagggaaaacgaggcatcctttcccggataaatttgtatatcgatatccgtctgctcttctttgctgtttggaagcacttcccccaaaggaagcagggagccttcctttacaaaaagaggaagcttttctatcggtgcatccacggtgatcgtctgaccgccgtccagtttttcatctgtccagaagtcgtaccattttgttccttcgggaagataaacctcccgggaaaccgccccctgttcggttacaggcgcaacgagaagggccgggccgaacatgaattcatcctcggtaagcgcacttttcccgtcggaaaagtccatccacaaagcccgcataaacggtgcaccggtctgctccgtccaaaatgcgagggaataaatgtagggcatcagacgatagcggagccttacatatttcaccaggattttttccgcttcttccccataggaccatacctcattatttctgcgggttccatgcgtgcggaaggtggggcagaaaacaccaaactgaaaccatctgatatatagttccgtataatttttcttggtgactgctcctttacccgaaccggaggtctgaatcagaagcttgctgtaatcctcctccgtgtcctcatcgggaagcgcctgccaccctccgatatcggatgaccagtagggcatgccgctggcacagaaattaagggctgtgggtatctgtcttttgagaacatcccactccggaaaaatatcggacgaccagaaggtggtaccgtatttctgcgcgcccagataagcggccctggatagtgtcaggcagcgatgggaaaatgctgctctgtggccttcatagatacattgagtatgggtaagagggtagatattatgaatgcgcgctccggttcctgcatgcagaaaggattcatgagggctgatatccggttcgtcttcatccgtccaataatatttatatcccagatcaccatagttctttttaatcgtatcaaaataccatttcccgcattccggattggtggtgtcaatcagcgcgcctctctgatcctccggcgttccgtaaacggtatttccccgggcatccttcatgaaccagcccttcttttccaggaattcataattctcactttccttcataaaccgcggccagcaggatatcattgtctcatagcccatttcctcaagctcccggttcatctgcgcgctgtcgggccagaacttcgtatccaggctcagatctcccagaaccttccaatggaaccagtccactacaaaaatatcgcagggacagcccttctccttatatttggatgcaacctccaaaagctcctcctgggaggcgtatctctgcttgcattgaatgaatcccagccctcttctcggcggcaggggcgccgctccgcaaaggcatctgtagccccggtaaatatcatccgttttctctcccgttatcagaaagaaggaaaccgcttcccccacctcggcctgccaaactgtatggccttccacaccgggtacagccttcatccgggaagcattatcaaagatgattccgtattttttattcgtaacaaggaagggcacggcaacgatttcaccgcccttatggctgtaatcatgccacaggatctgctccctgccgcccagatccagactgccgtcctgatgctgtcccaggccaaaatatttctcatcctccgaagcggaaaaaacaacccggatatggaaggttttttcgcccaggacaactgccggttccagacggcagtctaaaagagtggtcagcttctctcccatggccccggtaaatgtaatttccgcatcatttctgcttacttcaagtcctgcaccggacaggctgtagaggatcttgtcttcttcctctgtcagtgccgagtggctgtctttggacggcacggcttctattccccacatgggcaatttttctctgccgtctgtttcctccgtcaggcaggagctgtcattctgtgggtaatatacaaaatgcaggatattgtctgcataaggaacaatctgcattaccccctgggcgcattccattgtcaaaatatttccctgcataccgcaggacagtattttttccggtctgatcatgtgtttcctctcatcctgccgtaaatacggcatttgctgctgtatcaatacctatcctttcaccgcgctgtcaatggtcccctgaataaaatatttctggaggaatatgtaggcgatgattaaagggaaaatcgcaacacatgcggcggccgccgcaccatttaagtctttccctcctgcggagaagtattgagatatcatcagggtcaatgtgtacattttgggtttctggagaatgtacaggctgtatgcgtattcattccatatggaaaccccgtttaatattacgatggttaccgttacaggcttcagctggggcagaataatataaaagaaggtctgcgccaccccgcagccgtcaatagcgctggcttcatcaagggaaggggggatggccccgatgaagttggtgaagaggtaaatggtcatggggagcccgaacgcggatgacacgaggataattccccagagagtggatattccttttatggatacaagcagggaatagacaccgaccaggatactcaaagatggtatcatcataatccccattataataccttttatgagcccgttccatttgcttttatttctggaaagcggataggaagcaagcccgccgaccacaatttcaatcagaaggacacagaccgtcacaatgattgtgttcctgagggcagacggaatgttcccggactggaaaaccttgacaaaattagccgtatataccttctcaggcagggaaagcagagaggaggaatccgacatgcttttgaatgccattaccaccagtacatagatgggcaggacatgaaaaataatgatggcgacgcccagcagatatttccaccagtccttcagcagtgtctttttcatcacatatccacctcctttttactgaaataattagtgaagatattggagactaccatgataaataagaaggtgaatattcccaccgcagcggaatatcctgcattctgcgctttaaaatactggttgctcacgtaggaagccagggaatgggtggagaatcccggccctcctccggatagggatatgataacgtcgtaaagcttcaggcctccgatcagattgagcacaaccgctgatgatatggagggaagcagcagcggaaaggtaatgtgccggaaacgctgccagggactcgcgccgtctatttccgccgcttccagatacatctggggaatattctgaaggcccgccatgtaaatgaccatggcaatacccacatactgccaggaattcatcaatgttatgatgataacacctctggttccggaggccatccagtcaatgggcgccattccgaaaatacctatcatttcattaaatatacccctgttgtattgaacaaagaagtaaatgatatagcccatgatcagactggatatcatgaccggcatatatataaaggtacgtactacggaatgacctttaaaccgggaatttaagaatactgcataggcgagtcccagcagattctgaagcagcgtactgccaaaaccatagatgatggtgttacggaaggcgatcaggaagttactgtccttaaacaatttaagatagttttttaagcctatgtatttataatcctgggaatacccgttccactgtgtgaaagaaatccggaacgcctctatcagcggccacagaacaaaaaacaggataagaagcagtgcaggaatataaaatacattcattcttaggtttcgttttttcatattatataaccatacctttccgactcagctccgccggcagccgtgctgccggttttcatccgggacacaagtaagccgccgcgtatgaaccagtccatcacgcggcggcccgcctgcttaagccagcgccctgaaaataatatctgaaaaattactggctgattttttcatcatatgcggtcttaattgtttccacacatttttcaattccttttcccggattcataaatatttcatttccggctactcccatatcattccacataccgctgggaaggaattctctgtcaaaataattcacatagaggagatcatcgccgaaggcattcatcatgatattaaattctttggtcacatattcattatcattggtaacaccttccatagcgggaatctttccgtttatggtggcaacctttacagagacatcatctcttgccagatattcaaggagctttctgctttcctccggatattcggtatccttccaaataccatagcaggcgccttctcctgaagacacataaactttgccgccttcattgggtgaaggaattgccatgattccaagccttgcatcgggattataggaaagagcctgtgtaatcgtatgatttccgctgattacaatagcgccgtcgccattggcaagggcctgaatggaggcatcatcacttgcagtcagaatgtccttattgaagtatcccttctgctgccagtcatccagcatctgtgcaagaggcgtccagtatttttcccagtcaaagcttccgtccagcagagccgctccctggttatccgcaacatcttcattggtgaggaatccgggggccataacttcaaacagattggcaatgttattaacggattttccgcctacatataccggcacctttccggttgtaagaagcttgtcacatgccgcttcgaaatccgcccatgtacggattgttgtcgcatcaacgccggcctcatcaaaaatatccttgttataacaaatggatgccggatcaatggacagcgggaccacataaatattcccctgggaatcggtgactgtctttttgatggattctttcacatgagatacccatggctcgtcatttaaaggggtaagatattcggaatatcttgtagtgctccacccatgagtttcccataaatcaggaagatctccggaagccattcttgttttcattacattttcgtaatcatccccgggtgaaatcacttcaaccccgatacctgtttccgcagtaaaatcatccatgatctgctgaagtccttccagcatttcaccggtccatgttgtctccagctccaataccacatcagaagcgggctgtgccgtctgttctgcggaatcggctgtttgtgcggctgcttcggttttgctttcctcatcctgcgcggccggggcctgatctgcagtctggccgtcccctcccgatgaacaaccggacagtaatgctgccgacatcgctgccgtacataacagagctgtcaatttctttgcatgccttttcataacttaacccttcctttcccataacctgcagatttacttaggtaaactgccttaatttccgttttcttaccggatgtattcagtttatcattatggaaaactattctaaagtctgtttttttgtgtatattgtacttttttttgccatttacaggactttttttattaatttgacaaaccattttagttgtgcatataattacacctgacataattatgaatgtttcattttatcagggagtgacatatgatatgaatactataaaaaaggctctgaaaaaaaaccgttccttaaaatccacttctatgcttgcctttattgtatccttcctcattccttcttttctgcttatattgcttttgtttgtgtgctatatacagataacaattaaggcacaggaaaaagagtataaaaataccttaaacattttgtcctcccatctggtgaatcatataaacgccaactccggattatcactcacttatctgtttgatcctgagatttcaagtatgtttttttatctgaacaaaaaagattataccgaagacctgattacttatacccgtctgtcccagaattatactgccacattaaataatcgtatgactctgatcggaaacagtattaccggcattggttttatccccagcaagtctaacagcgatactcttttttacctgaaaaaatataatacccttcttatcaacgaagattatgagtatatggactccgactggtacaaacagcttcagaggaataaccaggccgccctattcgttccttccaataccgcttctgcggcgaataccatttctttgatacggacggttaaaaatattgataaacgtcaggtggtaggatatgagattctggatatctccctggattttatttttgagtccctgaaggatatttccatgagccagtactccgggatctttttggaatctcccaagcaggaactgcttttttccaccaatgaagcgctcactcctgtcctctcttccctcctcggatcggataacggcataaagcagccggaaagaggttatgatttatattcttatcgggataagaacttcggctttaccttttattatctttcctctcgctatgacctgtaccgcaacctgcgttttgccacaggcctggtcctgctattctatttcggcatggtcgtaatggccgcttttatcttcggacgcacctcccgcagcttaagcagctccatcagccctgtcctggataccatggataaatatcatgcaggtgattcccatatccaatgtgacatctcccaatgcagtatttcagaaattgagacgattgcggtaaacctgaatgaaatgatagaaaaaataaatacgcacattgacaacgaatataaatttcagatggaacaaaaaatagcggaataccagacgctgcagtcggaaatcaatcctcattttctgcataacacactgaatatcctgattgcgctgaaccggctgggggatcggaaaggcctggaacagtccattatcagcctttcccgcctgtaccggtatacctgtgagcataattttaacagcaccattcagcatgaatttaatttcataaaagattatctgtaccttcagaagacccgttttgatgaacggctggatttccagatatttatagagccgggactggaggatttcgaaatccccaaattccttgtacagccgttaattgaaaatgctattgtccatgggcttgaaccttcggaccgtaacgaacttattcagctttcggcttttactacaaaaagccggaacggagaggattttacagtcattacagtaattaacagcggcctgccctatattgaaaataaatcctacaaacgggtgggacttaaaaatattgaagagcggctgactattttttctcctaattccttctttattatccggggaggaatcgataaacctaccaaatgcaccataatgatacccaagccccatacggagaaaggaaaatgacatgtttatactgatcgccgatgatgaaaaaatgattcgtttaagcctgcagtccatgctggaggagctttatcccaatgaacacatgtatattcatgcttccaatgggcaggccgccatagcacaggtgcaaaagcttcctccggatatcgcatttctggatatccgcatgccgctcatgaacgggctggaggccctggaaacctgccgtaagctatctccctccacgaaatggattattctcagcggttatgccgatttcgaatatgctcagaaggccataacactgtccgcttattcctatctgctcaagccggtggatctggcaacgctgaagcaggtggtggatgatattgtcgtgttaaagaatcaggagaaagaacacgacaataaattatttacgttggatgtcatccgatccttcaatatggcggatcagctgggcagtaatgagacggcttttcttccttacggaactaacccttacgttatttatcagatttatattgatgaacaggaaaaagaacggcagcacatgctcaagcatgatttattccgcagtattgatgatttttgtcgaagaaacttatttttattttatcatgcggtatttttcaacaccaacggggagctttgtgttatctgttccgtaaaggatccttctcaccttactttttttatcaattcccagatacgctcctatcctcatgacatgatttccgtgtttaccgccgcagccggttccttatcggaaatctatgaagaaagccgccggatctcccgcctttcggaaatccgccttgtatatgactgccgttccgcggcggatatccgttcactgacagaaatccccatactacatgatcttctgtctttttgtgaacaaattgacctctttatccagaacgcccttgttggcagcagggaaaccatccgacagctttccgccgcttttatacaaaaccaaaaaatgaaaaagatatttgataatatcttcctgagtaccctgtatctttatctggaggacgtactggctcattcatttacggcggatgactttgccggctttgtcaaagagctgcaagccgcggcatcggaattatcccatatcgaaccactgaggaattttgatataacagttatcaaagattttgtacaccagaattatgcaaaggatgtcagcattgcttatgtgagcgaatattttaatctgtcccccacctatttcagcaagctgttccacgaaaagacgggacagaaatatattgacttcgtgacggaagtccgcatagaaaatgcgaaaaaactgatacgcagcaatgccaatatttctgtcaagcagacggctgaagccgtgggttatacaagtgtgaggcacttttcgaaaatattccagaagtatacaggggtgctgccttctaattattgatctgccataacaattcccatctgccctgtgcctcgtatccttcgccaaccggtttgccttcccgctgcggtttcccctatccgagagggctgtataccctgcaaaggccttctaaaaacgccggtccttagattgcgtcctttgcaatcttagtaccgctgcgtttttagcagagtgaaagcgagtgcaagcactcactacgtgcctgcgcagggtatacagccccctcggaaaggggaagctgcagcgggaaggcaaaccggttggcgaaggatacgaggcacagggcagatgggaattgttatggacatttctgaaaaaacataattttcgaaaaaaccattgacatttttctttatattttgtattattgaatggctatataaagccagatcgaagcgtggctcagtttggtagagcgctgcgttcgggacgcagaggtcgcgtgttcgaatcacgtcgcttcgacttagggaaagcccgggaacttaatgtttccgggttctcatttttacaggtatatgtagacagactatattctgtgttgttttatttatttctatcatcttaaatctaatattctaataatttattttctttatttacgactcttcattcccatttttctgttgttttatatccatccagttatgaatagtatacataaacgattccttgtagctaacgttttagaaaccagaatatttattcaattccatagtataaggcggagaaattaactataaacagataaataagaggattaccatatggcgaaaaataggattattacggttcaaaatatttcaattgctgttacagcggaggaaatggatgactatatctgtattactgatatcgcagatgcaaaatcggatcgatccagggcggcggatgtcataagaaactggctgagaaaccgctccactttggaatatctatctgtgtgggaacagttatataatccgaattttaaagtgttcgaatctgaacactttaaaaagcaggctggattactcacatttaccccaagtgtttctgaatggattgaacagaccggagctgttggattatatgtaaaacggggaaaatatggaggcacctatgcccacaaggatattgcgtttgagtttgcttcagcaatcagccctacattcaaattatacctgatcaaagaatttcagagactgaaagaagaagaaaataacaaggatcggatagaatgggatgccaaaagatttttatcaaaaaataattatatcattcagacagatgctgtgaaaaacttcctgattcctaaaaaaaattatagagataacctggaatggctggcttatgcagaggaagcggacattttaaatgttgcgctctttggttttacggcaaaagcctggagagaggctaatcctcaattggcgggaaagaataatgtcagagattttgctacggtgaatgaattgacagtactctcaaatttagagacacataatgcacaaatgattcgcgaagggaaaaataaaaatgaaagatttcgtatattgaaagaaattgcggaatatcagttagggatcttaaatgcagccgaacagattaaaatagatgaaatgaagaagtagcacagccgcgtattccgttaccagaaaaactggttgtgccatacttccccacaggatataatcagaagaataagaaacaccttatcacaaatcagccaatacggaggtactactattgaaaaacaccttactgctggagagcattaccggcgaggagatatctgccaatttaaagcccctggataatatcaggggatatgaagtaaggcccggattttatgaggttaacggcgcttctgccctgcccggcggggttaatttcactcttgcttctcacaacgccacatcctgtgagcttgtgcttttccacagaaaatccttccggccgttcgtcagtattccttttccggaacactatcggatcgggaatgtcttttccatgattgttttcggcctgaagatagacgaattcgaatatgcttactgcctggatggcccttacgatccggaaaaagggctgatatttgataaaagcaaatatattctcgacccttatgcaaaggctgttaccggccagagcgaatggggcgtccgccggatttacgagccggactgtctgtacaaatcccgtgtggtgagaaataactttgactggggcaattgtaagcagccgctcatccccataaaggataatattatctatgagcttcatgtaagaggttttaccaaagatgcctcttccggggtttcccatcccggtacttttgccggtttaatggaaaaaatcccctatctgaaagagttgggaatcaacgcggtggaactgatgcctatctttgaattcgatgaaatggccggctgccgggaggtggacggacggatgcttctggattactgggggtataatcccgtgtgtttctttgcccccaataccggttataccgcacagcttgaatataaccaggaagggctggagctgaaaacgcttatcagggccctgaatgaaaatgggattgaagtaatcctggatgtggtattcaaccatactgcagaagggaatgaacaggggccgttcttttcttttaaagggctggataataatatttattacatgctcacccctgatggctattactataatttcagcggctgcggcaatacgctgaactgcaaccaccctatcgtccggcagctgattctggattgcctgcgatactgggtcatcaattaccgtgtggacggtttccgcttcgatctggcttctattctcgggaggaatgaggatgcggctcctatgagcaaccctccccttctggaaagccttgcctatgatcctatcctgggaagcgtggatttgatcgctgaggcctgggatgcaggcggcctgtatcaggtcggttcgtttccctcctggaaccgttggtcggaatggaacggcaaataccgggatgatatgcgcagcttcctgaaaggggatgacggctatgctgctgccgccgcccagcgtattataggatccccggatctttatcctccggaaaaaagaggctccaatgcatccgttaattttcttacctgccatgacggctttactttatatgatctttattcctataacagcaagcataatgaagcgaacggctggaacaatacggatggcgccgtcgataaccggagctggaactgcggacaggagggcccgtccgacagtgaggaaatccggcagctgaggttccggatgatcaaaaatgcctgtgcggttctcatgtgcagccgcggcactcccatgtttcttgccggagacgaattcgggaatacgcagttcggcaataataattcctattgccaggacaatgaaatatcctggcttgactggactttagcagaggaaaataaagaaattcatgattttttcaggtacatgatctccttccgccgggaacacagggtgatacgggataataccgctccctgcagtcttggttttccgtctatgagtattcattctctgaagccctgggatgataattttgactggaacagcaaaatggtgggcgtaatgttcgccggaatctatccctccggcagggatgatatcctgtatatcggcatcaatactttctggaatccgctgacagtggagcttccggagctgtcccccgataaatactggattcccgcagtagatacctcaagaggaacagcagcagtcattacccgtgaggaaatactggatgaaaatgtttatattatgggcccacgctccgtattggtgtgccttgtaaaagaccgggcctaactaaaaaacgcgattctccagccggctgcatagcctttcatcaaaactataataaaaaacgaagccatctgacagtatatcgtcagcgggcttcgtttttcttaaagtggtattaatcgatcaatatatacagcaaagtaagcagaagtcccaaacaggcaaggaaaagtccaaaggacaggcttcttccgataatcgttccattttcctgtaaatcatcatgcatcatagcaagcttatgctcatatctgccttctgcgtgctgccttatatagatatcttcagctatctcttcctctgtggcatcaggatgattgaaatactccgtaaccccgtccagaacaattcccaccatatgggtcatgggtgtgccttcttttatttcatgcggaattctgctgtccctgtaaatagtctttcttaacaggactactattgtatccatcagtctgtcagccagcctgcacagggttccgaatagcagggggaggatcttaagaaggacaggccggtacagcagattctccaaatccagccagccgggccagcgatcccggtaaatcctgtttccgtcctgtactgtttccatccatttgcgtaccaccagcacataaagcagcagacctataagaatcgaaattccggccccctttaaattgatcagggagaaataagcaaccacagatttcaggctttccgcattcaggaaagcggcggacatatccgccagcctgtctgttatcagatgggggaggagccccagcagcggaaggagcacggcgctgcccgccagggcaaaaccgctcaggccgttcatataatgcttcattccgtcgaatcgttcctgacacttcctgtcattatttttttccacaaagagacagatgtaaagcttgagcatatacgctaccgtcatgccgccgctgattaggaaaatccattccacagcctgcatccagccagccccgcctgcatttgctgaggcaagcatatgcctgtattccacgatggattcatgcagcagcgtcttgctcgtatatccgttccacagaggcattccgccgatacccagcgcccccatcaggaaacagaagttcagcagcggcttctttctgccgaatccttttattttgttcaggttcagttcatgaaggttcataaatacgacgcctgcagccataaaaagcaccagcttgattagggagtggtttaccatgtgaagcaggcttccccgtatggccacgctgctctcttctccgataagcccctgcatgccgatcccgatcagaataaatccgatttgagacacggaggaacaggccagcgtccttttaagattcacggagaataaggcaaggagtgcaccggtaaacatcgtgagaacacccaaaaccagcagcagtctgccccacgccgcatcaaaaggcagaatagcgcagctgatgacaagaacaccaaaaataccggctttggtaagtatgccggaaagaagggcggatgccggcgccggcgctacgggatgggccttgggcagccagatgtgcagagggaagacaccggcctttgccccgaagccaaacagcaggcagacagaggcggtgaatatccgtacatatcctccgcttccatttaaacggctcttctccgccgcttgtgcgagccgggtaaattccagcgttcccagttccccgtacaaaagaaacaggcccatcagcattaccaggccaccgatgactgccacagccagataggtttcggccgcgcgcagggcttctttcgtctcttcatgcgccacccatgtataggaagtaaaggacatgatttcaaagaaaataaaaacagtgaagagatctgccgataggaacacaccgatggtggctcccagcgtaaacagagtaaaaaaacggtatcttcccctgttcctgtagcttttcatatattcggcggaaaacagcgtcgtcatcatccacataagagaagcgatcaggccatacagggcacggaacccatccatacacagatgcagccccattccgcagaagccttcccaacggtaatcataccggattccctcattgccgcccttccagaacaggccgaacaaaacggcaaagcagagcatctctgaaacagttaccagaccggcccctatatctgcagttgtctttctttttctgtacgtatcatttcccgctccctctcctcttcccagcagcgctaccacgaatgcccccagaaagggaaaacacaggattaataacagcatataatcaccagtcatgtcaggttcctccaacctctctttacaaatttccgccggctatttcctgaaagaaatttacaatcggtgcggaatgcaggccgaaaataaggatagctatcgcaaaaatacacaaaggcaccagcatcatccatcccggatccctggcttcctccggaatgttcagctgcttctccttatcagggaaaaaggcccggataacgatagagagcatatagatggccgttaaaagcgcagatatcagaagggccccgatccccacataggccatgacattatcgctcattaccgccgccgtcgccagattccacttgctgataaatccggcaaggccgggcactcccatcagtccgagggacgctatggtaaaaattccgaacaccaccggcatacgccttccgaaaccgtctatttcatgcacatactgctttcccgttttatacatcaccgcccccacacagaagaaggagcatatcttcataacagcatggaataccatatggcttaaggcacccaccagacccaggggcgtcatgatgcatacgccgaaaaggatataggaaaggttgcttatggtggaatacgcaagcctccttttcaaatgcgtctccttcagcgcgcggctgcagccgtaaacaatggtaaaaatcacgatccccatcaccacattctgcgcccaggttcccctgacaaagtccgggccaaagctgtaaaaggtcagtctgatgatggcaaaggctcccgcctttaccacggctaccgcatgcagaagcgcagtgaccggggtaggcgccacgcccgcctggggaagccaggaattaaaaggacagacagccgcttttaccccaaagccgcagaaggcgatgcagtatatgagcagcagcatggatctcttatctcctcctgtcacggaagcatccaggactcccccgaaggtaaagttgatggtcgtgccataggtcagcaggaagatcagccccagaaaagcaaatgcggcgcctcccagggagtaatacagatacttccggctggcaaggatcgcctctctggtcagcgtatgcagcaccaagggtacggtaaccagcgtgagcagctcataaaagaaatacatggtgagcatatcctctgaaaaagcaatacccagcgtaataccataggtaatggtgtaaaacatgaagaaaaaccgttctcttttctcatgcttcatatattcaaaggaatacagcgtcgccagcggccacagggcggccaccagacccgcaaaaaccatggataacccgtcaattttcagggacagagacagattgctcacaaaccggacgataggaaatgcatccacaggcctgtttaccagcagccccgccacaatcaggctggtcgtcaccactatgcattcaacgtataccgtcatataaattctttttttaaagggtatcaagggcaccacagcgccgccgagcacaggcagcagtacggccacaagcatcatttctggtttcatagatgaacacctttctttttccctggtacggacttaccatccgttttcttccgtctgcctacatctggaacagctgctgtgcaatgttgctgataagggaaatcaggcctcccgggaacatacccagcacaacagccaggacagccagcagaaggatgggaaccagcattacggaatccgcttccttccggacaaagccttttcgtgattcttcttccccggggaaaaaccccttcatggttatgggaagcagatagcccgccgtgagcagcgcggacagcagcagtaccaccggccccagccagctgtaaaagccggtttccgaggacagcgaaccgacagccagataccatttgctgacaaagccgcttgcaggagggatacctattaaagcaagggacagaagcgtcatacagccgatggttaccggcatttccttcccgattcccctcagctcgtccacccgcgttttacctgtccggaatatgatcgctccggcgcataggaacaggccggatttaatgaccgcatggaaaatcacatgcaggaatgcccctgtcataccggccggattcagcagaagaagcccgaagagaatataggaaacctggcttaccgttgaataggccagcctttttttcagtcctttttccagataagcgagcatggaacccaggaataccgttcccagggccagtcccagaaataccttctgtacccagcttcccttcaggaactccgctccgaaaataaagtaaaccacacggattatccccagcacacctgatttgacaataatcccggacagcacagccgatgcgggggcaggggctaccgggtgcgccgcaggcagccagccctgcataggaaacagtccggcttttacaccgaaccccataagcatcaggaaggcaaccaccaacaataatccttcatgcccttccacaagtgaaaaatccagcactccgccggctgtaaaggtcagcgtattcccatagcggttgataaaatacaggccaaacaaagccagatatgcgccggccagggaatagaacagatatttcagccctgccataaccgcctcccttgtgcgggtatggaatacaagaggaagggacagcagagtcatgcactcgtaaaagaggtaaaaggtaatcaggttcccggaaaaatccagccctacaagaacgccgtatacaatcagataaaatccgaaatatcttttattgcaatcctcgtgctgcatataccggaatgcatagataccggcgagaacccagacaattgtgaccaccgacacaaacagccgccccaccgcatccaccttaaaatagacaggaagccgcatggtcagctgaaacagcgtaaaggcagtctctccgctgccgattaccccgatgactgctatcgccgtcccgaaaaggcctatggcggtaagggttatcatggcagacctttttattgaatttttcaaaagcagcaacagaattcccatgattatcggaaaaaatatgggaaagagaagcatgcctgattccttcatataaagctcctgtctgcgcgccgtttccgcgcctggtaagaatttgataaaatcagccgaacatagccagccccgactggatccatttcacaatgggctgggacagcatgcccagggctatattaaggcagataaaaaggacaatggtaaccgtataggttttttctgcgccgatggtgattacctcacagtccgtacgcctttccggaacaaaaatccggatcaccgttttcatgaaataaatagcattcaataccgtgctgattcccagtacgataagggcgggaagcattttgtaagcatgtccgatggaagcctgggcaaagagcagcttgctcacgaagccggataacataggcattcctaccatggacaaagaacccacggtaaaaccgattcccgcgattttatgcctgtaggccgcccccgtaagatcctggaatttcctgctgcctttggaaacatccgtaaggccgatagcggagataaacaggagggatttggtggcggcatgggaaaggatatgaaaaatactggcaaccatgccgatctccgtacccagtccgaagcccatgtaaatatatccaatctgggccacactggaaaaggagatcatccttcggatatcattttcctttatagcactcagggagccgaatatcatccccatgagcccgaatacgaagaatacgttgattatcttgttctccgcaataaaatcaaagccgattaccctgtaaataatcttgatcagcagaaaaatataacccttggaaaccaggctggaaagcatggccgccgaagatacggtggaatagccataggcatcaggcagccaggagtgaaagggaaacagggcgctttttatggcaaggcccacgcagattaagccgatggtcaccaccagcggcatccggaattccccctgggcgactatctctcccacggtttccttgatattgctcatgagcagatggcctgtcatatcgtagagcatgctgattcccaccagcagaagtccgctgcccagaaggctcatgatcatatatctgaccgccgcttcaatcgtccttccgttctgcctgatcatgatcaggccgcaggcggatatggtattgatttccacaaatacataggcggtgaacaggtcgttggtatatacaagggccaaaagggaactgagcagcagatccgtgaggatataataaagattgtgcttgctgtattccacctcgcccagaagcttcttgcgcccgcccatcagggaaaggagcatgataatacagaaaaagagggccatacccgcttccagaactcccgcacggatttcatttccccagggcgccggaaaatggcccatcatataggtatagctggttcctttacccatgaggtacaccagcagcacggcggacatacagcccacggctccgataacaaccgtattcagccacttggcggcctttgccggaagaaccgagctcaccgtgccggaaaacatggataaaataatggagaagaagggaaagttctgtacaaaatccatttacagtccctcctttttcagtctggcggaaatctcgtccagatccagcgtatggtatctgcggtacagacggatggtcagagacagcatcagcgccgttaccgaaaccgacaccacgatgccggtgagtaccagcccgctgggaaccggattgatatagcttaccaccgtctggaccccatccaccacgataggagccttacgtcccatgatatagcctttttctgcaaggaacaggtaaaccgcggtatccatgatattcagcccgattattttctttatcaggttcttctgcaaaagcaggttggagaatccgataccgaacaggatcatggcaatcgcttccccgtaattggataaaaggttgccgcccatcctagaatccccccttcctgaacaacgcataaaaagcgtacatggtacaggttaccaccaggcccacgcaaatattaagcaccagtatcaggccgctgctcagtatggctccgggagtccctaagggtatcccgcttggcagatggttggcgcccatataaaaggaatagcttttcgccagacagtagcaggtcagggaacaaaagcatatccatttataagtcttttccgtgaaaaaacgttctgttttcgcaaacccgaaggcattcagatacaggatgagtcccgcgccgataatcgcgccgcccgaaaacccgccgccgggggacagatggccgttcagaatgacataaatgccgaatataataatgagcggcaccagaaaacccgccaccttctgcaggatcaaatcattttttggctcataaatacggtcgttctcgtccgcttcagcccgggtcagagcattatccctgctttccccttcctttttatccgtcttgtcaatgcgtagcaagataagaaccgtgaccgtggcgataaacagaacgttggattccccaaacgtatcaaaggccctgtaatccaggatcatgccggtaacaatgtttaccgcccctgtttcctgaagccctttggtaatataccgctccgacacctcattattatccgggttagaggcgtttcccgtcctgggaagataagaaaccgtcaccagcataatggcaatcaggctgatacagaagataacgcccatcacccggtaagccttgttaaacagcaggagcttcttattatgctccatatcataaaccttttcctgaagctgccggtattcccgcatcctttcctggacgctggcttcctcttccttatattccttctgcggcttcatttccaccttgcctaacaggggatcctcttccccataaaaccagcgggaaaaacggctattcttcttttctgtcatcttcgtcgtcctccctccggatagcatggatctttttcagcgtcacaaagaaaagcacgctggtaactcctgcccccacagccgcttccgtaattgccagatccggggattccagaagaatccatatgatcgacataaccagactgtaggacataaaaatcaaaatggaattcagcaggttcctggagaagctcaccgaaacagcacatactaccagaaagcccatcagcaggtaagtaaatgtctgcatatcattctcctttctcctcccgatccagcctgtcatcctcttcatagtccagttcacagtgctccttcagggtttcgtccgtcataacctccagacgggaaatcaaatgggaggaaacaggggatgcgaaccacagaaacatgattaccaggagcatcttcaggctggtaaaattcagcccggaaatgatgataaggcctgtcagggaaattccgatccccagcgtgtcccccagagcggcagcatgcatccggttcagtacaaattcaaaacggtaggatccgaatacctccatcgcaaaggtaagcagccctgctgcaagaaccaccgttccgattataaaacggagcaattcaagattcatgagcattttcctcctccggcgtatcctttttcctgtcttttttcctggtttcctgataaactcccatgtataccttggtcagcacaatgactgcaagaaagcttatcatggcgtagataatacagatatccaccagatagccttcctgcagcaaaagcgcaaggatggctatcataaccatgaccatggtgcccatcatatttacggccaccagcctgtccgccacacgaggccccctcacagcccttatgaggcagagaaggagcataaagccgagaaaaatcaacgctgctgtaaacacagcttcatatgcattttccaaaccgttcatcctgccacctgcccttctattttgtgcagaagccgcacaaaaacgctgtccgaaagcccttcactgaaacgcctgtccagacaatgcaccgtatactcattgtcctgcagggctaccgtaatggttcccggcgtaagggtgatggaattagccagaagcactctggcagtttttgttttcaaatccgttttaaagcggacaataacaggctgaaccctgatatgaggggatgctacgagcttaagagttgccgcattggctttgacgatttcccagataagcacgcccagataggcaataatataaccgaacttacgcatgataagccagtccttccggggactgtaatccaggaacttacagcagaaggcataaacagcccctgcgattacaattccgaacagtactatttccagcgtaaccttcccgttaaagattacccacagcaaaaaaaagagtatgtacataaaatgccttcccctcatcaatcaaaaaattcatctgtcatccggattacaattacatcatgagaaaacggacgctggctgttaagccaacgtctgctccagtttgtttattaattcatttttggataccgcgcccactattctggctttttcctggccatccttgaaaatcaggaaggtggggatattcatcacactgtatttctcggcaatatccatattctcatcaatattaagcttaccaaccttggcttttccatccatttcttcagccagctgctccacaaccggcgccatcatcttacagggaccgcaccagtccgcaaaaaaatcaactaatacaggcttgtccgactgcagcacctctttttcaaaatctcctgtcgtaaatttatattccatgataaaacctccttcttattttctgtctctctatttattcttgaccattttctgagttccatacaatcagctgcctctgtcagcataaaacggagacataagtttatggtataagcatattacacatttttgtgctttgcaaggacaaaaatgcttaaaaattgcacatattattcattccagaaatcagaggggcacataccggtatgggcgcggaaaatacggctgaaataaaactggtcctggtaccctacctgttcggccacatcctttacatagatccgggatccgctggtccgcatgatttccatggccttttccatccgcagcctggtaaggcagctgttaaaggactcgccgccgtatttgcgtatcagcttgcttaaataggtctgggatattcccagcgccctgctcgcggactgcagggtcagctgctgggcgaaatgtccggagatgtacttcatgattttattgtagtattcctgtgtatccattttcaaaaagtccgcttcctcttcgggtgttttaaataggatttccgccagattgtccgccagctgctgtacgttttcggaatagagaaaggcatcctccaataaaaattcctcttcccggttccagcctttgccgctgcggtatttctgaaggatataggagatcttgtgaaccatgccttccacccatatctgaggccgttcttccttatcccatttgtacagcagccggatcatctcttcctttgctctggagaaattggatttcatacagtacttttccaaaccgcacagtccgtcctcctgaacttccggctcctttccgcatccgtcctcttcctctcccttcagatggatcaccttgtttttccctaagacaattccgcagtccagggccctgtacagctttttcataagctcctgcagccggctgcagggtaccggctcatctccgtacaccgcggtaaaatatgcggtctgcggctgttccttttccaccttatgttcaatgagcctgataaaatcattcccgtccaccagttccttgggacagatatacagggcttcgcattcatctcttccgtatataaatattgtttcattggaatctgaaaatatttccacattcctctgtccggaaaatctgggcggcagtccatttctgcggacaagagccgcataataaagggcatagggaaagtatttttccatttccccctccttcggggcctgtcccagggaaagcttccttatgatctctttacgtccctgataatatttatccttcagttcctctttaagcttaaaaagcagagcctgcagttcggaaggaaccacaggcttcagaatataatccctgacgccaagctttatggcggactgggcataaccaaattcagaataaccgctcacgatgataatctttgtatcctccccgctgctgtaaagagcttccgacagctgtatcccgtccataaccggcatgcgtatgtccgtaattaagatatccgggtgaatatccagcgtcttttccagcgcttcttttccgttgcgggctcttccggccacgtaaaaatccgggcactttttttctattatcgattctatatgtttcactgcagtgggttcatcatctgtcactaataccgaatacatccccttcttcaccctccttctcaggatccttccttcactccgattgttatgataactccgctctcctgtttattttccagacggaatacaaggccgtccacatacagcagatacattctggcgtataggtttgccagccccatctgccctatttccatctcaatgctgcttttttgtatgtgtatcttttttcttatctcctccagcttcgccagcagattctgaaggacggcttcttccatgccgtctccgttatcctccacactgatataccatccgttttcctctatccagcccctcacctttatgcgcatgaccgtatctttttgattgtagccatggagcatactgttttccaccagctgctggagaacgattttgggaatgatttttcttctgatggattcctcacaggtgatttccacctccagcctttcttcaaaccgggatttcagcagatatacgtattgtctcagatagtccagctcctgctccaccgtggcatagcgttccaccgtactggtggaatagcggagcatggctgccagattttcgcagatgtcacatattttctcatccccgtcttccattcctctgttggatatcacattcagcacattataaaggaaatgagggtttacctgggcctgaagggtaccaaactgagcctgaagctgtaaaagggacagctttttttccttatccagcgattcactgagacgtctgagcagatccctataggagcggttcaaggcttctatttcattatccgatgtgttgatgatgagctcctgatccagattgctgagctgcgtctgttcgatctgcttgcgcatgtcccttatgggctttgtcagataggtggaaataaggattacaaataccatggaaagagaaaaaatagtgactaccagaagaagcgagaataccgcggtctggggaatcccttcccgtatgatcctcatatcctccgataaaatgatttttgcgcctgttttggaggtgcttaaggataataataaatccgaaggcttatcttcataagcattatcctcacaggaggatgcatatgttctgtaagtatccagattttcctcatcggttgagtaaaagaggctgccgtcctccagaagtatggttgtccttatttctctttccggaaaggaaaacaattcctccagcctgtcgattttctgctggacctcgatatatccaagaggctgtccctgtacggcgcggaccatggaaaaaaccttctccttactgtcggccttccagttatcctcatggatgcctaccaggagaggctttccgtgaagattacgggcctcctccagccagtaacaatcctctatcgcggtcttgctgttgattacgcccatatccgtattcatcgtgctgtatatgatgttaccgtatgtattgaaaaagataacacgatagaaattggacatgaagtagtcgttgctgatcccatttttcagaattgcttcattctccgatatcatttccgtataccgtctgttttctgtatcggaaagccctctgatcgcccccagcatatcctgatcggacaggatataattcgtcacctggctcatggcgttatagctgttgtcgaattgtatcgtcatctgctccgacaggaatttcaaattttcatgggcgttggaacggtattccctggtattgtaatactgccatacaatgcctaatatcagggaaaggataaaggcaagcgctgcataggaaacgatcagcttatatcgaaaacgcaattgatattcctcccgaggctgttatgaaaaatctgcatttccatattttcataactgttttttgaaacatattatgattatatagaaatgcagatcccggaacaagcatttaaaagttaggatttccaaaggctgacactaccccttaaccgctccggcgaccataccgtctattatccttttgttgaagaaaataaacaaaaccaacataggaatcgtaatcaccagcacatccgcgaacagcaggttgtaagagctggcatacttgcccttgaaattataaagggttaactgtaccgtagcattggcattgcccggcaggaaatagagcgggttggtaaaatcattaaaaatactcaccgcattcaatataatcaccgtggaggtaacaggttttaacaggggaaatactactctggaaaacagctgtattctgctgcagccatcaataaagcccgcttcttccagttctgtggggatggttgccataaatccccggtacagcatgatggtgaaaggaatattcagcgccacttccacgattgtcattcccagaagcgtcttataaagatgcaggccctgaagcacccagattgtgggaaggatagccggagggaccataaggcccgacataatcagcacattagccagcctggttgtcctgtcgttccttctctgaaggacataaccggccatggaaccggtgagaatcagcaggataacggagcacagtgccaggatgaggctgtttttaaatgcagtgacaagcatataattgtttgccttgattacctccaggtaattttccggatgaatttctttcggaagcgaaagcgacatcagattcgcttctttggtcccctttaaggaattgaccagcatatagaggaacggtgtgacaaaaataacaaggcaggccgccattcctatgacgtccccgcagatcgtcaacagttttttcttcttcatcaggaatccacctccctgctcagcagaaacttctgcaaaggaaacgcaagcagcgcaatcatgataaacatgatcacatttccggctgtggaaagaccgtaaaatccggccgcatattgtttataaacgatggatgacatgacgtccgttgcaaatcccggcccgcctcctgtcatggcccaaattaagtcaaagctgcgcaggcccccgatgaaggacagaataatgacggaattcatagccggacgggcaaggggcgccgtaatggaaaacagcttctgtctggcgttggctccgtctatttcagccgcttcataatacgtcttatctatagactgtatccctgccacatagatgacggtggcgatgctcagccccttccatacatccaccccgataatggaatacagagccaaatccggatttcccagccagtttatgttcgctgctccaaagagccccagggctttgttgattaagcctttgctgggatgcatcatcgcggtaaaagtgatgccgattgccatggtactcaccagattggggaagaaaataatggaacgctgtatattcttggtacgtatggatccggtaagaaaaacagcgataaaaaaggccaggagaaccttaatgccgcaggttagaaaggcatatatcagagtgtttttaataccaatattcaaagaacgttccgtgagaaacattttaaaattatcaaagcctataaaccgataggttttaaaatcccataccgtcatactgaaaaaaaacgaagtgacggtggggataataaaaatgatgagaaaaacaatcatggccggaagaagaaaccatgtggaatacattttctttttcttcatatctgcaatcctttccttatctgtccggatcaggacggccgcctgtgttacaggcggcctgccccgcatacatatctttgcttctgccggtactcactgtttaccagtcaagccctaactgcaccgcctgcttcaggcagtcatcatcataggccttcgccgcttcttccgcagaaatctgaccggttcccgcttcctgggtaatctgctcacagcttgcgccctttacggcagtctgatactccagggccgtgcaggccttgcccgcatcaatatatgcctgctcatcctttaccgcctggaaggcatcatccggaagagccattcccttaatgataatggggcctgccggaggctgcaccgccagataagcatttatggcttcatcgctcatccaaaaattcaggaaacgaaggatatcatcaatattttcactgtttttatttacataaagcccgcctgccggccatgtggtaattccgtgattgtctgcgtcgtccccgggaacgccgaacgccccaatcttgttgacatcctctccgtactggctgttaatataagccagcacaccgtcactggtaataatccaatgggttccttccccgtttaccagcatatcacaggccgtctggtaagtggttgcggtatagtcttcattgtaataaggaaccagatccacacatttctgccagctcttaagacctgccggttctgacgcatattttgctgttcctgcttcgaattctttggcaaaatcaggattttccgcctgtacattataatgatcgcccagataaaccacctgtgtggtccagctgtctgcaaagcttccgattacggctacttccccgttttctttcagcacatcacagtttttaaggaaatcagcccatgtatgcggcacctcaagtccgtatttctcataggtgtccctgttataaagtacgacgccagcaccgctggcaaagcctgcaggcaccccatataccttgccgtctgccgtaacagcgctgaggaaggattcatccagccttgacaggtacgcctgatccgataaatccaggaaatattccgaaggattcagtgtcgtgaacttacagcctgagttataagcgcacaaatcggccatatccccggatgccagccttgtttttacaatgttatccccgtccgctccgcctgcacggatttccacgtcaaccgttatgcccagtttttctttagccagggcgcataccgcctcaagcccgtcaagggtggaatccttatcgatcagtaggcttatggttgcttccttatattcgtattctcctcccgcagcttccgagccccccgcatcggttgtttccgcagcttcctctgttcctgctgccggtgtttccgcctggttctctgcggattccacaggggcggagccggcagaacttccggagcatccggccaggatacctgaaaccatcgccgcactcaacaaaatactcaataactttttcttcattcctcttcctcctctttttttattcggtacgttaattgtaaaaagagaggacaaaaaaatacatggataatccactcattatccatgtactttcaagtttttatatgacatgttaaattaataaaacatgatatccttcagatccatcagctttccggcaatcccggtgaattttatgtagactgcatgtactcccgaagggacacgcacaggactgtcaaattgctgaaaatcaaattttccgcttgtcctctttatctcgactttggcgaggcattctgattccatgctgtcaatatagatctccgcagtacctccataggtgctgctggaacaggagagggaaataccccggatttcacagttgaaatccatataccggataacgccccagtcgccgttgtggatattagttaaatattcataatgcatatctctgctgctgtaggcgtcaaagtagcatttccccgacagccggcacaaagccgatgcgggcagttttcttttgcagggtatcgggggttccgttccctggctcgtcatcagaacctcttttatcgttccgtcctcttcaaaaaatatctcttccacacagactctgcggctaaattcactgttatgagaggaacgatgataaaagacataccattttccctgatattcttcgatcgatccatggttattccagcttgccggatcacatcctgtattatcaatgataatcccttttttcgtataggggccgagcggcttatcactcattgcatatcccaggcatgtgggcttcccacgggagctgtccgcatagacgagataatagatcccgtttctttttctgattgatattccctcatgaaaaccatctctgtcttccgttaatatccccttaaccattgtctcgggaaccacttccgataaatcctccgacaattttccccctctcaggcttccctggccccaaaaatagtacacctggccgtcatcatccttaaatacagcgggatcaatctgtgttccgtccgctccggctataggaaccgcatccgtgaaggggcctgcgggactgtccgaaaaagccacgccttccgatccatccgacaagcaataaaacagacaatatctgtccttgattttcagacaatccggcgcatataaaggcatttttccatgggctgccatgtgggaggcctcatcataggaaataaaagacacaggatgtgcccggaaattcttcatgtcactgctggaaaatacctgatattcgtagctgcagtattcatcattgccgcagcagtcctttgagccatataaataaatattgccatcctcatcttttcgagcctcaacatccggtatataatactgggacggtaaaatcgggttcataatataattcctttcttcattaaccttttacggctcctgccgtcaatccttctgtaatagtacgtgatacaaatgcgtatacaatcattatggggactattgacatagcgatagccagataggtagctccgtaatccctgttaaaggttcccctaagattcataataagcaggggaagcgtaaaatttttctggttaaacaacacaatcataggcgtcatgaagttattccagcttcccacaaagttgaaaatagacatcgttgcaatagccggttttaccatcggcagagcgattctgttaaagataataaactcgttgcagccctctatcctggcgctttccagcagagaatccggtaaagaggatttcatatactgcataatgaaaaacaccgtactcgcattggcaatcccgggcaggataagcgggaaaaaggtatccaggattcccatgaacttacataaccggaagaacccgatgattcccagctgcgaaggaatcatcatggaaaccatgacgataccaaatacaattccctgccctttgaacctgtatttcgacaggccgaaagcggtcagcgcgccgaaataggcgctcagcagcgtggaggaaaaagaaataatcacgctgttcagaaatcctctgccgatctgtatcatttctctcatattcaaataattctgaaagatggaggctccgggaagtaaatacaagcctgtcatcagctcattgctggaatgtgtggcattaatgatcatgatataaaaaggcagaaaacaaatgactgtaagcaatatcagcaaaatatagataatgattctggagagctttatctttttcatgactcctctccttcctgcttagggttgagaactctgaaaaacagaacagatactatcaggatgattatgaataatccataagaaaccgttgccccgtatgcataatttttattcttaaaagcggtgttatataaatataaaaccattgtcataagcgacttctggggttctccggttcctcccgtcagggccatcgggatatcaaaaatctgcattccgccaatcagagaagtgactgcaacatataataaagtgggtcttatcagaggcattgtaatgtaaaaaaatctttgtctgctgttggatccgtctaccacggcggcttcaatcacatccgtagaaattgctttgattcctgccgtaaggatgatcgtgctgtgcccgaaccacatccaccattggatgagagaggtcaggcctctggcaaataccggatttcccatccattttacaggttcattgatcagattcatggataataagattttattgacggtacctgtctgccagtcaagcagcacgctgaacagaataccgattgaggcagccgtaactaaattgggcagataaaacattgcctgaaacacattggcgcctttcagtttgtactggcataaaaggacggccagcaccagcgcggatattatctgcggtatgatacagccaagccagataatccaggtgtttcccacacttttccaaaacacttcgtcaacagcaagacgctgataattcttcaggccaataaatcccgccgtggctccgtcttccatacttaaaaagaatgtataaataatcggatataactgaaatataagaaaaacaatgatataaggtaaaacaaagagaaagccataccgggcccttttcttagccatactttttactacccccttaccttgtttgaaaaaggaaaagcagttcatatttatgggctgcttttcctttcgtttactactctaccgtaatggactgatatgcatttgccacatcttttttaaattgttccagggcctcttccttcgttacttctccctgggcatataactctgcattctgcaggagcagattattgatagtatcatcatactttgttacaagggaagcatttattttaccggcttcctctttgaaaaatgcaaatgtgttctggcctccgcaccatgtatccgagtaggattccaccagctcgtcctccacagataccaacgccgggaaatccgatttatctatcgcatactgtctgctgtaatcaggatccagagtgataaatttcagatattcccatgccagttccttctgggtgctctttttgtaaattcccatataggttccgccgttaaagtaagatgcaggcatacttgcaatcgcccagtctcctttggaatccggcgcacttccctggattacatactgcattccccaggtaggcaggacataaccgaacagagaatcgtcagctgctgccgcataccatgcggtactccatgcatccagtttggcatcataaccgttttcccggaatgtttttcccaaatcaagaaattccggcacataatcgtccatgatgaatttaccgtcttttacccagggctccttacgctgtccatagcaggacatcatccataaatcctggaagtttgtcacgaacgctgtctttccatcgcttttatcatgaatcgtcttggcgacatccagcattccctctgtgcttgacagcattttggaaacctcttccggatcatccgttcccaggtattcttttgccatgctgcgcttataccagagtccgcccggcgtagcctgccagcataaagctctcagattcccctgggcatcggaaccgatttccttggtatagcctattacgtcttccgcaagtgctgtggcattatagggttcggccgataaattttcccaggcatccgattccagataattcttcactaccttggcgtccgcacagaaaatgtcggggccgtctgcctcattatccacaatagtctgcatcttgacatcataatcttcaccaatctgggtaaattccacctttacattagggtaaaccttattaaatgcttcgatctggtatttgggatcgtctgtccaggaccatattgtaattgtgccgctgtactccgacggatcctttgcttcaaaagctgctgtttctttttccttggacgggctgcttccacagccggccatgcttcccaataccattaatgctgctaaacaaacacatagtttctttttcatcttgcctctccttctcttgaataatgatttatctgcaaaatggtagcgctcccatttttgccacgaaaaaactacaccgaacatgtagtctctttctctgaaattacagcagggaaaattttacgtaactccacacttttcccttccacctctgcaatcattgtttccgcaagatatctccccatttcccttaccggctgctttacagtggaaagcttgatataagggccatagttcatgaagataatatcatcatatcccaaaacggatatatcctcaggcaccctgtagtttgcatcctttgctcctcttgcgaagccatgtgccataacatcgttaaaacaaaatactgccgttgcctttgtatctatgatatctctggcacgttcaagtcctatgtcataggaaaattcaccatcgaaaatcaaagattcctcatagggaatatgattttcctccaaagccctgcggtatccttccaaacggcccagtgtttcataattgttccattttcctgttaaaactgctattcttctatgtccaaggcctatgagataattggtgccgtcatatgctgcctttacattatcgatatctgcctcaattactccgtccacctgaatccctgtcttaaacgctgctgccggcattcccattttaacaagcttttccagctgttttctggataccgaaccttcccccagataaatgaatccatccacttttccattaaggatatcaataggatccttgtgcccgctttcatcggcacggtttaccacgaacagagtgctgtaacctcttttttcacaaatatggtaaatctcttcactgactatggaatagaaaggatcattgaaggtataacagctgatcacaccgatattcatacttcttctcgatgcaagggtcctggccgctgtattagggctgtaattcatttcttcaataacctgcagaactctttcttttgtcgcaggcttaaccttgtcgctgcctaataaaactcttgatacggttgtcttggaaactccggctttcttagccacatcaattatacttgtcatgttatcacctttttcacatagtaacataaaatgggaacggtttcaatgtatataatacacaatattttctcaatcatttttgcagtaatgtatagaaaaagctgaaatatatttaaatttttcctgattttacaaagaaatcctttaaatataattcagctcttattctctttctaataccgtattacaggaatattgcaggaatgaatgcttctgtcaccgccgtatcacatacttacagatagggttgcccgccgcggaaaaccgctcttcatactccgtcatgatatttccccggacaagaacctcatctgcatgaagatcaaaggtgactgtatcggctttccagcccgcaggctccagctcctccagtgcaaaatcaaacaggactctgttatctgttttgaattccagtgttccgtccttttttaagatctcgtcgtatctggcaaggaactgtctggagggcaggcgtcttttcgcatgcctgtccttgggccagggatccgagaaattcagatatatcctgctgacctcctctttatcaaatacattgcagatatcctctgcatccatacggataaaacgtacgttgggaagctcttcttcctccattttctgtatggcgcgcagcagtacgctggaatacttttcaattccgataaaatttacttccggatgctgtccggccattcccataataaatcttcccttgcccattccaatctctatatgaatggggttctcattcccgaagacctctttccattttcccttctgtaattccggttcatgtatgacaaatcggctctctccgataacctccctggagccgggtacatttttaagtctcatttgttttcctctctatccgcagtctttcgctctatcttttcacacagggaatccaccatatttttcacaagttccctgtccttttcactcaattgggtaaattgccttgccaggtgcctgacatcatcattaatatccagatcttccagaacgtccatatacatgggttcttttccatacatgagccagtccgggttaacattatattctctgcatatatctttgaccgtccgatcggtaatgtttctctgtcccttttccatgttggttatcgcaccgcccgacatattgatcgacgcgccaaaggcccgtgttgtcagctttagttgttttcttaaatactgcagtctttcatggatatccacctcttcacctccatgaaagcattatagcttattttgatttcaatgtaaacatggattcgttaaagtgttgactttattttaaaacaacgttaatatattttcagagaagccgataacggaattatagattagtccatgaacgcaagtacattgaaaaagaaacagagtgcctgatatccttgtgatgtcaggccttttttccaagagaggtaagaggctgaaaagcttttctttcagcctctctgatttatatgcggcatatgccgcgtgcgtacataatgtgcgcagaagggagtaatatgaagaataatgtgaaaacggacacgcccttctgggatccttcccttccttttgaagagcggctggactggcttttatcagaaatgacaatggatgaaaagctgtcctgtatggctaccagggttcctgatctggaacgattagggataccgggattttctgtaggcggtgaagccgctcatggtgtggaggcaagaaatgatcaaaatgatttgggcgctgcggaacctaccacttctttcccccagcctatcggcatgagcgccacatgggatccggatcttatcaaaaaagccggtgaggtgaccggaacggaggcacgggttatttatcaccgtcatcccgatcgcgggctgagcaggtgggcgcctaccgttgatttggaacgggatccccggtggggaagaacggaggaaggctatggggaagatccggttcttaccggtgtcatgtcttccgcttatatccagggcatgcagggggatgatccgaagtatcttcgtgtcgctgctaccctcaagcatttttatgcgaataacaccgaagcgggccggggatggaagtcttcctgcgtagatcccagaaaccggcaggagctgtatctggaacccttccggagagccataatgaacggccgggcggaaggcgtaatgacggcttataataaaattaacggcattcccggaatgctcaacccggaagtgagggaaatcctgaaaaaggaatacggcctgaaggggcatgttgtctgtgacggaggcgctatggagcttgtggccaatcttcatcattattacggccttcatgccgaaactcttgccaatgcggttaaagcaggcgtagacggtatgtccgaccgaccggaagcagtagctcaggcagcccgggaggcctgggagcttggcctcataacagaggaggaaatcgacgaagccctgcggaatatattccgcacaaagctgcgtcttggtatttatgacagggagccctgcaacccttatgacagggtgacggaagaagatctgaattctcccctcaataagcaaatctgcctgcagctgtcccgggaagccattgttcttctcaagaatgaaaataaaatgcttcctttggatcctgctgtcccggcagaaaccatggctctggtcggtcccctggcggacagctggtatcaggactggtatgggggaactcctccttatgtaaccacactgcgccagggaatgaaggagatacagggaacacaagtaccttttgccgacggtcttgaccgggtgatattccgctgcggccagaagggtgtggcgacggcagcagacggaagattgtacctgtcggaagaaccggatgtctttgtaatggacgactggggagaaggcagctataccttccgctgtgaacgtacagggaaatatatgaatacaagaatgggccaatccgataaggaatcctcggaaacgggatggattgctgcggaaaaggacgctccttttgactggtttgtcatggagattttccatgtactggaacaggggaacggcatgatacagcttaccaaccgttttcattctcccgtggaaattgatgaaaaggattttcttgtttccatgagagaaggatccgccgcacaattccggatggaaattgtggaaaacggactggaaaaggcctgcagcctggttcagggaaaggaaaaagtcattcttgcccttggctgcaattccatgatcaatgcaaaggaagaagtggatcgtactaccattgcccttcctccggcacaggagcatctgctggaagaaatttaccgtatcaatcctaacgttattctcgtactgttctctaattatccttattctatcaatatggcccaggaaaagctgcccgctgttttgtggagtgcaaccggaagccaggatatggggacagctatggcagaaacacttttcgggaaaaatgcgcctgcaggacgtctcaatatgacctggtaccgttcggatgagcagctgccggatattgatgattacgatatcataaagggaaaacgaacttaccgctattttgatggtgatatactgtatcctttcggatatggcctcacctattcctcctttacatatacggatttttccgcagcgcctgaggataaccgaaagctacgggtatccttctgtgtaaccaatactggtgaccgggtcagcgatgaagtggctcagatttatggaaccgctccagcctcccgggtaaaaaaaccgataaaacagcttcttgggttccgccgcctgaagggtatccttcccggagagacccggaaagcagaatttatgatatcgattgaagaattccgtttttatgatgtaatcagcagaactatgatggtagaggaaggatgctaccggatatttgccggcccttccagcgcgcagcctcagttggaggcttttgtggagattcccggcagaaaacccggactgcgtgatttgaaaaaacggataccggcagatcattatgatgattacgaaaatatcactctgacagaagggcatttcggcttcaccgccgctcttcccgtaaacacggagaaaacgggcaccctgatataccgcagctgcaggcccgaattcggattaaaaaatgccttcttccatttaaagagtgaaaaaggcggaagtctggagctatggatagatgggaaaaaggtgagtgaatgggaaggtgatacaagaacctacgaggctgtacctccctttttaccggatgaaaatgcccggaaggaagccatagaacggacaaaatatagaattcctgtttatacggatgtgaaaatttctcttcaggatatcccggaatgttctgaaggagaagccgtactgcagatacggctgcatggagatatcaagctgtgttatttccgatttgagtaattttttattttctgtacttcggacataagatcgtgttcacgtaagcatcaatgtttccgtgaacacgatctttttatgaatttttccttaaatattaccatcagacagcgtatgatgatataaatctcaatcgttttcctccctatattctccagtcggaaattctctttttgcagcatatttacctttcttttgtaatcaatttgatattggtgctcgtacggataagctccttcatttcctcttccactcctctacgtcttgcataacggaacattttcttttggtctatcaggtatttggaaaatgtctcctcataaacagagggatattccgcacgttcaatcaggtgtccggtcagtttcctgctgaacaaatccaccagcagtttctccaggggggcactatagggctgtccgacaggctttggcgcctctgaaatcaattttaaaataacaatggtctgttctggagatctataccggtaaaatgtctcttccgatgggaaaagcaacacacagggaaacttactttttaaagtatggaatacagcttcctccaacatagcttccacttcgataaatactgtgttatgtgcgatctggtggtttacaaactcattgagctggatcagttcccacgcctggaaatctacaagaggatactctttttcaataccagaaacaatttgattccactcgctggagtgttcataggtataaggcatcttctgtttctcctgacagacagcttcaaaaatgtttttgcctagtttctgtattttgttttcctgctggagcttccgcagcagccaatagacagaacgttcactgtactgaggattgacttcatgtatcaaatcagcaaattcattttttgtaaaaatccatcctggcttcggtagcagactttgcagttggttcatttccataatatcacatcctctaatatcgctttgcagttttggcatttttattaattattgccaaaactgcaatttattataatcaataagaacaaaaatgtcaatatagcagctccatcccattttcgataccggaacaaattttttctgaaggaatgattctggtatatcagaaatggatgtcagaaacaaaaactgcttccgtgaacacgatctttttatgaatttttccttaaatcccttaaattttatcatcagatagtgtatgatgataacggtaaaaacgtatcatacacatatgagtatctcaaaatcatacgattttgagtttaaataagaaatataaggtgaaataaatggcaatgcaccacagaacaaaacataaatttatactttttcttaccttcttctttttatgcccggcacttgttttttccatacctttgtctgcagctgccgcacccgcttccggaaacagcttccaggaagaagcagaggcgcgcaaggagatgcctgtggaatccaacgcacgggaaaactggccggcaggccctctcatcggcgcccagtccgctattttgatggaagccaataccggggctatcctttatgaaaaaaatatccacgacaagctttatcctgccagcataaccaaaattcttacagccctgatcgccatggaaagctgtcccctggatgatatcgtcacctattccaatgaagcggtaaacagtattgactggctgaccgattccaatatggggatcaaggcaggtgaacagattaccatggagcagtctctctacgggcttctggtcggatccgccaatgaagcaggaaacgctatcggagaacatatcagcggaagcattgattccttcgtggacttaatgaataaaaaagccaaagatctcgggtgccgggattcccactttgttacttccaacggaatttttgatgagaaccattatacctcggcttacgatatggctttaattgcccaggccttcttttccaatgacctgctgtgcaaaatggcaagtacggcaaattacaccattcccgtgtcctccactgttagccaggaaatgaatgtacacagtaaaaatcagctttttgccaataaaccttatgcttatgaatatctggtcggcagcaaaaccggctatacctcggaggccagacagacgctggtatcctgtgcccagaaagacgggctgaagcttatctgtgtcattatgaaggaagaatcgccttctcaatatactgataccatagatctgtttaattacgggttcagcaatttttatgccgttaatatttcggagacggatacgaaatatacagtgggaaataatagcttttttgaatcggacagcgatgttttcggtaattccgctccgcttctggctatcaattcttccgatattatcgtacttccaaataccgctgattataaggacgtggaatcggaactggattatgagggcggaaacgaaaaagctgctgccataattaattttacttacaacggctcgtatgtgggaagcgcttctgtggaaattgtgcaggatacccctgccgtttcaaagacaggagacagcgcaaaaaccgccttggggcaggtttattatattaatataaaaaatgtcctgattattgttatcgctgtggttgtttcgctgtttgcgctgatatccattgtttctctgataagaaattacagctttggaaagcgcaggaaaatcagcctgaaacgaagcaaacggcgtaaaaaggatgggattgattttgacaggtatacgaaaggaccggacggcttctgactgtaatcagatgttttctttgccatcccggtatttcctgggggatattcctacctccagcttgaatttacgggaaaaataactgacatcatcatatcctatctgtgcacagatatccatcatggaaagctgtgtacttcgaagcagaagctttgcacgttctatccgcaaactagtaatatatgtccaaaagctgattcctgtctcctttccatataggcgtataaaataatttttactcaatcccacataatcggcggcgctttccagtgaaagcttcggatccctgtagttttccattgcataagcgttcgcctttagtacaatggatttatttccggcgaattcctctcttttttctaaatcctccaggtattttataatacagctgagggtatattttaataactcttccgcacattctattgacaggaatctctctatccctatcttatccagttcttccgcagactgtaaaagccctagatccttcatatgtattttcagctgcatgatcatattatagcagaaaccctgcagctgcccgggactgcgaagttcctcctgcgcacaggaaaatatatcccttagaaaatctgatacctttgttatacttaattcctgcagggcaccggatacaatattcttgatctcatttataggaagtggggaatcttcctctttaatccccttcagaaaaatgtccatatgattttccgaatgataaaaactatgtattttattcgctttcagactgctgcataaagcctgtgggctgatattgccaccggcttcctgcagcaaatatatagaatattttaaatccgggggtatatctttatgatagttccgcagaaaatccaatgtattttccttcatgggagaaacagcataaataatacggttattcgctgatataaagcgggcataaatcttaatacctgcccttcttatatattcggaaaagatttccgaaaggacttccgtatcacctggtttttcctgaatattccagcgaaaagaaatatcaatgagtccgtattttccctggatcagtctgctgtgattcagccatgccgtgttttcttccgcattcatacttgctccataaagtctctgaagctctttctgtaatagcagctcttcactccctgaggaagattcttcagccctgctggtttcctgattcagttctgctgtgatttttgacacaattttattgatggattcacggctcaccggtttcagcaaatacccattggctccaagatttaaagcctcctgggctgattcaaaagaatcactggctgtcagaagtacaattttcactctcttgtctttttcacgaatatacttcacacagctcaatccatccatgagaggcatttttatatcaattataataaagtccggtttttccttttcatataaagaaagagcctctaccccgtccgtggctgttcccacaatctggcagccaacgtctgcccaatccacaagcgcattcagcaccttaaaaataataggttcatcgtccgcaaaacataccttatacatattcatcacctgctctcctcatccggaattgtaatgataacccgggtatactcttcctccaaactatcaagcacaatgccataggaagcaccatatttcagcctgatccgtgcatttgtatttgcaattccaactcccggatttctcagggctaattccatatttgttctgatctcctccattcgttctgcactgataccatgtccgttatcaaagacttcaaatacaatatctccctgtccccgggtaataaggagtcttatctctccgccttccttcctgtccttaaaaccatgcttaatactgttttctatcaccggctgaagaagatacttgagtatctgatgatccataagatcttcaggacaatctacagaataaacaaaaagacgtggaaatcgcttttggtaaaaccccagataattatttacatgctgtatttccctggctatagtagtcatttcatcggaatgatctatggtataatgcagaatttcccccaaagcggaaagcatatcttcaatttcccggtccccatgcaggacggcttctccatgaatggtctgaagaacattatataaaaaatgaggattgatctgactgaccagcatttccagttcaatatccttctggtgcatctgggccacatatacatcattgatcagtgaattgattttaccagccatttcttcaaatttactgcggataaccgttatttcccgaaaactgttatccatatcgtcaaaggcgacagcgccggatccgtcatatgaggatattctttcgattacgctgtcaacaggtttctgaagcctgcgtgtaatataacgaagaataagaatgcaaaatcctactgcagcacatccaataacaatagcaaaggaccagatagaattagcagaacttctgattatttcgttggaggtttccgatatgataaaccatcttgttgtctgtatctgtttactggtgtataaatttccattcagtatagtctgcatgggtgtatctgtggttctattcctgtttattgccgtccagatatctccgatttcatccggagaacggtcgtttacataatcataaataagcttaccgtcttcatcgaccataatataaccttcggctgaatgaatactcgtcccataaaacagactcgaaattttattggcatttacttcacataaaatatatccctctactttatcagcctttttcaccggataaataacagaaaatacatttgcgtatttttcgttctgtctggaatagtgatcaactccgtgaggagggacatattttatggccgacggctgttccagagccttctgaaaccaatcgctgcctgtaaaatcatagttccggcttaatgcattggtgactgaaaaaaggattttggaatccgtattcatgatcacaagatcaacaacatggtcataataaatatgaatctgggatatgcttgtttcaacctcccgtatattagccagccagctggaatcatatgtatcattgctgttaagaagccgatgcacggcagactggttcccaagggataccagcggtgttgtaaggcttttaaactgatcatctatactgcgggagatttcattaacaaattcctgcttatcggtaagtatgcggtgatgcatccagtaactattcagataggtgataccaaatataagcaggaaaatggccgccagaaaaacggtagctacgctcactgctgttttggtaataattgaggactgctgtggatggtgatgcttaagcataaaataccccctgaaaaaactgattttatgacaaatttatagtaacattataaagcaggcatgcgtatatttgtacaaaaatattatttaatccacatgttttctatgcaaagatattataattcaagttttgtgtattatatcacatttactttgaacaaaaaatgactagaattttaagtatagaaagcacataaaaggtaatatatgacagttcaattgcttcaggagccggcgcctgcagtatagaaacttagtaaagcaatcttatcaaggagggttatgaatatgaaaaaaagttcaaagttttttgctgccgcacttgcagccgtactcgcattttccgttaccggctgcgctggcgcggactcttccggggaagcttcctctgctgccccatctgcagctgccccggaaacttcagcagaaagcactgctcctgtaactgaaggagatgcccccagcggcacactgacttttctttcctggcagaatgaaaccgtaatgcagcctttactgaacggtttcaaagagaaatacccggatgtaagcgtggacttgatctatgcgcctccggtacaggattatgttgaaaaattccagattatgtactccacaggagatttaccggatgtctttgtaacagctgcggaaaacaaaggagaagtcctggataatgatattgccatggatatttcctatctgcccgcttttgaaaaaatgtccgataaaaataaggagacttatacaaaagacggaaaaatatatgctttcgcacccgatgcctggattgcaggtatattctataacaaaaaaatattagaggataatggaattgcagttcccacaaaccgtgaagaatatctggccagtatggcggccctgaaggctaatggaatccagccctgggccttctgcagtacaaatctgtatgatcccattcagggctatgttgccacagagaccataaataaaaacggcagctatgactctcaggtaaataacggagaactgacctatgcagatgggtggagcgaaccggttagcctttgggcagctgactaccttgaacccggatatattaatcaggatgctcttggacttaccggagatcaggtaaatgaaatgtttgcattcgaggaatgtgcctatatgatcggtgccacctggtctgttgccactctagatgaactgaatcctgatctggaatacggcatgcttccctggttcggaacagaagatggagtagcctggatgacaggtgcaacaggggttggctggtcaattaatgccaaagcaaaaaatatgcctgctgccaaagcttttcttgaatacctttccagtgatgaatcattgaaaatattccaggaacagaccggcggactgcttgctgttgacggtattgacttccccattcatcccactattgaagagggatatccttacctgttagaaggcaaattctatctccccgcagttgagtggaagtattcagatgctcttggcaatgaaatgcttataggaacacaggaaatcctcacaggaaatatcacgcccgaacagttagtggaaaatatggataaaaaacggactgaactggatgctgaacagtaagggaaaagcgaatactgcttgattaaattcagcggaatagcggatacgcattccgctgaatttatgaagatatcttcaacgaaaggagctgcctgtcttgaaaaaaactctgaaaagggaatttccctatctcctgtttatactgcctgcttttttggggtacacaacctttaccatagttcccctgctgaacagctttaaatatgcgtttacaaattgggacgggttcaacagagctgaatttgttgggtttaaaaacttccttgatcttttcggggatgcacccatgatgcgtgctttgatgaataccctggtatatgcggtttctgtgcctcttctggttactctgtttgccattcctcttgcggttttactaaacgggaaaatgaaaacccgtaatctgcaaagagctgtttttttctttccgtccgttcccagtgttctgattctgggatatctgtggtcttatatgctgagccctaccggaagaggattaataaataccattctcgctattttccacatagataaggttctgtggctgggaaaacccatgctggctatgttttctatcattatggtatccgtatggtcccagattggatggcatgcatgtatctatctggctaacctgcagagtatcccttcttcctatatagaagccgcccgcattgacggtgcttccggatgggatattttccgccatattaccttccccatgctggctccatctatgactatcagcgttatgctgctgctcaccggcagccttaaggtattcgatctgcccttttcccttaccaacggaggtcccggctactcaactcttatggtaacacaaatcattattacacggggcgttacggaaaagctgtacggtaaagcaaccgccatgtcggtagtattcttttttgttatctgtatctgtactatcattcagctttccctgatgaaaaagagggaggaaaaacttatatgaaaagaaaatctaatcttaagggttatacctggaaaacattccttctggaaatcatcatgcttttattatgctgtattatagtgctgcctttttactaccttgttatcagtatttttaaaactccaagagaaatgggactgaatccactgggacttccggaatcattgtatctggagaattttaaaaatgcctgggcacagattcattttgtaagagctttttttaataccctgcttattaccttctctacattaattgtggtaatcctgtttggttccatgtctgcttatgcggtggcaaggcggaaaagcagattttacaagctggttatgctctattttcttctcggcttcatggttccgttccagaccacaatggttcctctgtatcagcagatgcagcgttttcatctgattaataaactgtacggactgattgtcctttccaccggaagctgtgtttttgcattcttcatgtatcagggctttattaataccgtcccctacgaactggaggaatcggcaattattgatggggcaggccctcttcgtgtgttcttccagattaccttccctctgctgaagccgattacagtaactatgacaatattccatgttatgggaacctggaatgattttgtaactcccttcctgtttcttcatacaagaaacaacgccactcttatgctggaaatgtaccggggtgtgggagaatttcaaagtgactggccgcttatgatgactaccatggtactgattatggctccccttgttatcttttatatctttgctcaaagatacattatagacggactgacaaacggagcggtaaaaggctgaaatacttcaggagtatagctaaaaacggacggcaccaaacgtgccgtccgttttcagctttccttatgcttcctgagcctgcgaagttcgcgggctctttctttctttttaaatatatccgccgcatcctcttccgtaataaacttcatggtctttaccgcataaaccctgtcgtcctccgttttgcggacccgtattttgcctttcataaaaccatgtttttcacaataggatacactgtaataatgctttccgtttggtgtgaaccaccggatcttctttttcaggttgcggtggcacagatagcatttggtggaagaaacctccttgtcagcaagaagctcctgcttatccgcaaaatccctggagatatacttggcataatcatcaaagacaatatgaacctcttcttttttgttatgaggcacaataaagccgtcaaaggatatcatctgcagtacctggggatccttgattttggccagtacgcgtccggtataataggcatcgctcagtgccctgtgaaatggtatatctttggatatggcaagaaaatcaaccgcatattccagattgcggcgtgatttcttatcctcgaaggctatactgaaaagcttctgtacatcatagaatttcatgggctttttatcaagaggctccatcccatagaacttcatattccgctgcagctccgtcagatcctgaggcccccaggttccgaacatatagtcctccccgcaccaggcaaggaagctctttattacctgaagaaaactgcgccctgactgaagctcctccatatcaaggtgaagaagctttttcgtcatataatgcatttctttataaacctgcggccgtataagttcatgaaagctgtcgcatatttccatgcggctgtttaacttaacggcgcctatttctataatctcaaacggcagttccttcagctgtttttctttctgttcattcccctggttccattccagatccaatatgatataattcatatactattatgcttctttcgtcagcttcttttccagtttccctgccatttccttcagacagccttcctcaaagggaagcttcagtcccacttctttaatcatgttattaaagaaatctgcggcggacaggcggcagagcttcagatagctcttccatgcggcctcaaaatcttcatccatccacagtttatattcaaaagcaaccgtctgtgcgataacataatcaatataataaaaaggaaagctgtaaatgtgatgctgctgctgccagtatcctccctttccgaagaattcatccccttcataatccagatgaggcttgtattccttttccagcctgctccatgcttctttcctctgggcgggcgtcaaatccggattggcatatacgatatgctggaattcatccaccatacagccataaggtatgaacatcatggcgtcctcaaaatgcatttccctatacgcgtccgccttgtccccgaagaaccagtccatccatttctccgtgaagaattccatggacatggaatggcattccgcggtttccattgtgatatccccatgctcccggatttcatccattcctgacagatagccctggaaggcatggccgcattcatgggtaataacatccacatcggcgcttgttccgttaaagttggcaaatataaagggagacctgtatacgggaagataggtcatatatccccccactcttttattattgcgccccagcacatcaaaaagttcattttccatcatgaaatcaaagaattctttggtttccggagaaagctgtccgtacattctctgccctgcttccagaatttcttccggagtaccgacaggattgggattcccttctttaaaatatactccttcatcaataaaggaaagcttgtcaagtcccaggcgttcccttctcctgtcatgaagcttctccacaaaaggaacaaaatcctttttcacctgatcccgaaaggcttctacctgttctcttgtatagcagttgcggttcattcggtaatagcccagttccacataattttcatagccaagctcttttgcctgcctggtcctgttctttaccagcttatcataaatatcgtccagctcttcttcatgcgctttgaagaaagcggaaaatttttcccacgcttttctgcggacattcctgtccggatttttcaaataggcttttaaccgggaaatatttaccttttccccgtcccagtcaaattccgcagaagcggggattttctcgtaggcggtcgtcagggcattttcctcctgaacaaggggaatcagcttctcctgcatggatttctgggacaattccatatttttaaaggctaccagccctatcttatcctccagaacattgcggtaaggggactcgtacagcagcttctcgtaattaattaccatattgctgtaacgagggctttcctcatcgtagtaatcctgctcggcactgtaaaattcatccgcagtattcacatcatggcggatatgggcaattgtcatcagggtatccaccctgtcacgcagctcataatatttccggtgcactgcaaactgttcttccccgtttcgggcctctttaaactctttcataagctgagtgaattcttcttccactttattgaaatccactctttcgtaaggcatttgtgaaaatttcatatttgctcccctctgtccgctttaacgggcgtttgattccggaaaactgaagctatcattttcagctgttccatcttattttcttattttatctcacaggtacctgtctcatacttttttctgcattcctgaagcactttcttacggccaacgcagtgaatgcgctgccctgcagaacagttataatcagtttacaataatttacaggtatagtcaaacataccattcagctcacagcgccgaaaggcacaaacaaaaacagggcttttaaaccctgtcttttgttgaggtaagataacgataccttttttgcagagggtgttatcttacctctttttgatgtatgttagatagcataactctttacgtcggctcctatctgtctgaaataggagatactttcggtaggcttgtcacctgtatcaactctgccgacaaagctataaaagatttcgattttgcgggtgttcgtttccttatccagttcgtgaataagaatacggtcaataaattcatggacgttttcgtaggtcagttcttcaatcgctgtgtatctgcgtaccagtgcgacaaacctttttacgtccgcgctgcgctcggtggcgttgtcgatttcctgtgacagctccgcaatcctccgggtcagcgtctttttttcttcatcatagccggaagtcagaaaagcaaattgttcatctgaaagtttccctaaagcgttgtcctcgtagagcttgcggaataagatgttcagctcgttaatacggttctgcgccttgtcaagctctttccgctgctgtgtcagcgtcttttgtactgcctttgcgctgcactcgttggctgtttcgataaactcctgttcatgctctttcacataagacgttactcgctgcaagtctgcaaggacaagttctttcaatacgcttttgcggatataatgcgtagtgcagagcatatcatttcttgcccggttgcggtagttgccgcaagtgtaggcgtgtttccgttcaagcgtcccggctccgcgtactgcatacattttgtagccgcagtccccgcaaaagagcagcccggaaaacaggtcaatttcatcaacctttgtcgggcgttgccgggtggcaatccgcttctgtgcaagttcaaaggtttcttcatcaatcaaaggttcgtgagtgttggggaagaaataccttttttcctccgggttctttttcgtctttttcgacttataagataccttgtaggttttcccggttatggtatgccctaaatattctttccttgtcagaatgtcgtacagcgtcttatccggccagttgtaccatgcgttgagctgtgggcgggggtggcgtttgctccctgtcctgcggtagcgcagttccccgacggtcagtatttcattgtcccgcagccagttctggatttcacacatacggtcgccccgtacatacattgcaaaaatctgttttacgacgtgcgccgtttccgggtcgggtatcagatgattgcggttatccgggtcgataaggtagccgtaaggagcttcgccgttgacgcgctcgcctttctgcgcctttgcctgtttgacagcccggattttctttgaggtgtcgcgggcgtaaaactcgttgaaccagttccgcagaggggtaaactcgttatcttcccttgctgtgtctacaccgtcgttaatggcaatgtagcgcacttcatattcgggaaagacaatctctatcagctccccggttttcagataattacgtcccagacgggaaaggtcttttgttatgacggtcgccacgttcccggcttcaacctcatgcagcatggcttgaagcccctcacgctcaaagctcacgccggaaaatccgtcgtctacgaaaaagcgcgtgttgaaaaagtggtgttcgtcagcatacttttgtaaaatcagtttttggttctgtatgctctcgctttccccggcttgcatatcttcctggctcaatctgcaatataaagcggtaatcttgtctgtctgtaacattttgtcctcctttccgacgacagacaagcatggtatttgtactgtctatattataccacataccgctgcctgtgtcatgtataaaatgtgaagaaacgccctatttccgggcgtttgcggggttcagttccatgtctttgcgaatgagtttttttatctttttatccagtgtgtccgttgcgcgttcacttgcggacgaacatacaaggtaagtaacttttcctattttatgctccgttgtggtaacgggcgtttggttttgcgtcaaagaaaatccccctttctttcgcaaacatataatatagtctatgaatagcagcaagtccactattcaataaaacaaaggctttaatcggacggttattagcataacctcatgggaatttcaccccggcatggttctcatgccgccctacccattgcctgcgacgctcttaacgctcggactgtggctgtaaggaagtatcattgtatattctgcgtgtcgtcgcccgcaagccgctacacttgctttccggcgcggtgttggtcgctcggctgtccgggcggggataacctcacccggatagcgtcatggcgcacccgccgtatggctcggcgcaaaaggaacgtatccgatttgccctatgctgcgccgccgttatcttgcgccgctttctttgtcaaggttcagaatggctttgctgccgcgtcagcagcggaacggaaaagggggagagagaaagcgtcccgccgccgctgcggtttattcctctgccttaaaggtgaggacagccatcatcagttttgcttgcagccgttcccgaatgtcgtggtctacgccaaaatagacgttcccgcgctcgtcgtacagcttccgcatggagaggcgggctatgtagccgctgaaatgctgcaagacaatcttcatggcgtccgggtcgccctttgtcgctgccacaatgacaggataaggaacaagggcattttccgggtagccgggttcgttaccattcgtcccattcatcagcattttcctccagatattttcttaatttctcaaaagagcttgtccgcctgtactgtatcgtgcttctcgacgtgttgaacagctccgcaatctcggtatcgttcattccctcgaagtaatacagcaatatggctttgcgcttttcttccggcaaagtacggattgcttcaagaagcagctttggcgtgattttcttcccggctttctcaaagacggtttcggcggcttcacgtttgaaatattcatcaaacgtatgaagctgccgcgcttcgtctaaggtcatgtcggaaaaggtcacttcctttgccttgtgtctgcgaagttctctatgggtgtcgcaagcttcattgtgcaataccgtattacaaaacttctgaaaagcacactgtttgtaaaactccctgctattaggttccacattctcacctcctttctcgttggaaagttggtggtgcttccccccttttcgcggggcaatacggcgtttttcaaaaacgccgaagattttttgaaatttcttcaaaaattttttgaacgtacaaaatgcgcccgtccgaaaagcccggacgggcgcataggcattgtaagcagtatccagatgattagacagttcatatatataagcgtagtttcccccggtggtgggcgggctttttttgataagtcaataactgtcggattttgtcgatatgctttttgcttcatggcggctacctcctttagccgccgatttcaacagtgataccgcgtcatttcattagaagataaaaagaaacggcggctttgatttttcaaagctgctgcggaaatcaaagaacgacaagcaacagttctgattttgctccaatatggttattaggggcacaaattaaaatcaaaaaagagccgataacagcagtatttcaaactgcatattatcggctctgcgtctgtgcgtctggctcttttaattaaattatttctgttgttttttggctttattatatgtattagctaactgtccacaagctgctttaatctctctaccatgagaaactctcatggtaacttcaagtcctgtttgctctaattgatgtttgaacgcaaccatttcttgtttttgtggtgctctaatttttgaattactcgtcgggttgtattgcagcacgttaatcataacatttttgcccttaaaccattttgcaagttgccttatatctgaggaacggtcatttatacctggtaaaagcaaatacgcaaataccacttttcgattatgcctttgagaataggacaatgcttgcttaacaacatcttcaatagcgtacatgtgcatatgaggaatgatacagtttctcgcagcctgtgttgctgcatgtaaagatattgtcaactgaatttttagatgttcttcgcgcaatttttttaattgattaactggaccaactgttgatacggtaatgccgtcggttggaaagttaagtccatttctatctcgaagaatatggattgctgcaatcaagttgtcgtaattgaataaaggttctcccattcccataaaaacgatacgatttactttttgacgtatcaatacaacctgctgcacaatttcagacggtgttagattacgaacaaaaccattgcgtccggactcacaaaaaatacagccaacagaacaaccaacttgcgtacttacgcaaacagtcccaccatctcgccgtttaataaaaaccgtttcaatatacctgttatctttcaattcataaacatacttttcagtatcgctacttttatagactttttttgttgatattgatagattttctttgtgaaatggctgtttatacaattccgtatataaggctcttgctttatcctctccaattacttccgacatttctttgtaagtaaatccgtatgggtcattcaatatttccgtaggtgtacttttaggtaagtgtttcatttaaatatccttccttttcaaaattaaaaagtttgtttttcagagtttttgattatgatttctagtttttcaacatcaacgatatgcgttaatttacatttagggcagaaaagaggaaaatttcttaataccgtattataaaatacttgaaccctcgtctttccgttacaaattggacattttatccaatatttttcaagcataatatttctccttttgcgcaaaaaaatgcaggtcaattctcaacatgagcattgacctgcatttatacatataatactacaacaaaattaaggcatagtttttatactatgtctatacgtcgttagttttgttgtatagcatacgcaaaataagcatgacaaaaaagcccatattgaaaatgggaaaaatcttttttgatttcaatgcttatcgaatacgcatgctatgtaacataaacattcccccccttttatataatattatatacaaaagcagcttgttgtcaacatatatatatatgaattattttggctaactgatagaactacgtagacatatccaagaagaaaggggaacagtaaaatgtaatagggtgaataactatggcaaaaagaccagtaccacgatacgactttaaggcttttggggcagcgataaaggcagcgcgtgagggatgcaaggagagccgcaagaaagtaggcgacgaaatgtttatctcgccgcgctaccttgcgaacattgagaacaaggggcagcacccaagtttacagatattctttgagctgatacagcgttaccatatatccgtagaccaattccttttagaaacgccgccggagaagaacacgcagcggcggcagcttgacgcgcttcttgacggtatgagcgatacaggcatacggattgtaaccgcaacggcaaaggagatttccgaagtcgaaaaagagggcgaataggaatgtccgacttaaaactgaacaggatttagaaagcgttgtaatcttttttgaggttgcagcgtttttcttttgcgtaagtttggcaaaatcgctttttctccgtagtaggtgataagagcctaaaggataaaaacattcgtagcaagcataggaagcgggtaccacttccgtattttcgccctcccgcgctgcggcgcgtcggttgaaaattgcttgttgggaagtgtcccaaaccctcggaacggaaaggaaaggagcgaacacatggacggacgcaaaaggacagtgcaaatcaaattcagagtgacggaagcggaacgggatttaatactggaaaaaatgaagctcgtacccacccggaacatggcggcgtatctgcggaagattgccattgacgggtatatcattcagatagaccacgccgatataaaggctatgaccgcagagatacagaaaatcggtgtcaacgtcaaccagatagcacgccgcgtaaacgcgacggggaacgcataccaagaggacatagaggaaataaagggggtgcttgcggagatatggcggttacaaagattaagcctattaaaagcactctaagcaaagcccttgactatatcgaaaacccggacaagacggacgggaaaatgcttgtgtcctctttcggttgctcctatgaaacggcagatattgagtttgaatataccctgtcgcaagcactccaaaaggggaacaatttagcctttcatctgatacagtcctttgagccgggggaagtcgattatcagaaagcccatgaaatcggaaagcagcttgccgacgcggtaacaaaggggcagcatgagtatgtactcacgacgcacattgacaaaggacacgtccataaccatatcattttttgcgcggtgaactttgtagaccaccataaatacaattccaacaaaaggagctattacggcatacggaacatgagcgacaagctgtgccgggaaaatggcttgtccgttgtcgtcccctgcaagggcagcaagggaaagagctatgcggagtaccaggcagaaaagacgggtacaagttggaaaggcaagctgaaaaccactgttgacgcgcttatcccccaagtttccagttttgaggaattgctaacgcggttacaggcggcgggctatgagataaagccggggaaatatgtatcatgccgcgcccccggacaggaacgcttcacccgccttaaaaccctcggcgcagactatacagaggaagccgtaagggaacggatagcgggcagacggacaaaggtggcgaaagctcccagagagcagcgcggcgtgtcgctgcttatcgacattgagaacagtatcaaggcagcgcagagtaagggctatgaacagtgggcgaaaatccacaatctgaaacaggcagctaaaacaatgaatttcttgacggaacataagattgagcagtacgcggatttagtcagccggattgaggaaatggcagcggaaagcggacaggcggcagacgcattgaagaacgccgaaaagcggcttgcggaaatggcggtgcttatcaagaatgtttccacctatcaaaagacaaagcctgtctatgacgcataccgcaaggcaaggaacagggagaagtaccgcgccggacaggaacaggcaattatcctccatgaagccgccgtaaggtcactgaaagcggcgggcattgcgaagctcccgaacctcgccgcgctgcaatcggagtatgaagccctccaagcgcagaaagaagccctttacgccgactatggaaaattgaaaaagaaagtccgggaatatgatattatcaagcagaacattgacagcattttacaggcagacagacagccggaacgggaaaaggaaacagaacgcggataaggatagcaaaatccccgccgctgtgctatgatagggctatcaaaaagcagaggagcgttgagcatggaaaaccagaaaatgccggaatatgaaaccatacgcgccgccgttgccggggagaaatgggcggtggagaaagtcgtggattgctacaaggacgaaatcgacaggctatcgacggtagcggtcagacagccagacggaagcacgaaacaggaaatcaacgaagatatgcgccagtctatcacaaagaagctgatagaagccctcccgcagttcccgcttgaagaaatggaaaagggaaatgtcagataggcaaaaaaagaacagggcgcggaagccagtatatgacttccgcgccctgtctttttatgggtgctgttttcgtgaatgttacgcagtagaacgccattttcgggggtaaaggtataaagtatcgcctatccgattttcacgcccggaaagccctgtaaatcaagggattttccgcacctactgcgtaacaggggtgcgtcttttcctcatgcgctcggcagcttgtctgcgggtgatacgcttccggcagacggggcagtatttgacactgttagaggttgacgcaaagaacgcgccgcactcggtacacttcttcttgtcccctgtctggtaaagctccgcatagagtagcctgtcggcgggaagcaccgcagcccggaaccacttgcagagaagcgaataggaaatgagctgcggacaaacgcactcgtccccgtcgtccagtaagatacagttcccgttatcataattgcagcacgtccggcgcacaagggcgttgactttccggctctggggcggcgtcagccgcttaaccccgttcatacttcatcagcggcgtaaatgggaagctctgcaaattccgcttcggtcaaagcgtccactttggaaagggtgcgctttgcaagctcccgcatatccgcgtccatgtagggcagcgcggcgttgacattctcaatcaaagcccgcttgccgccctcgttgtaaatgctcaaaaggtttgtttcttcaacagtcagtctaatcatgctcatacctccatatcgtgattttttgtttttgccgccgcctttttcggggcggtctttgccttgtctgctttaagctgcgcccggatagaggggcggggcttccttatcttcctgtcccggttctcccccttgtcaatcagcgcatacgtcccatgtctgccctcgattttggaaaaggcaagggtcttgtagggcagcatggagaaaaggcggtcagtgtcctttgtggctgcaagctgcatgaacgccggggaaagctctaccatgaaatgggtcttgttggggctgttcggcgtgtcgtgccgcttcatttcccgtacaatgcgccgcgcttccgtttcaatcagcccgtcccgcaatgcggcgatatgcgccttgaaatcccccggcggaagctgctcccggctgcgccgttcttcctgtaagagcgattgcagcgcgtccgggtcgttgggtacggcttcaaagcgttcaaactttccaagctcataatcgggattgccgttgaaaaactgtccggcgggtatctcccgttccccatgctcataaatcagcttcaccgtatcggcgggcagctccttttccttgacgcgctcataatgtttagcgtagtccagttcgtacagattgcccttgattttcccgcgctccgtccccgttagctcgattgcataggcaaggacgcggtcgctcgtctgctccatgtagaaacgccatgtgttgtggggcgcggtgtctttgaggaaaacgtcgcgctcccggaagcaatgcgtcccggacgggcggcagaaccacaaaagggtcttgtcctccttgcgggggcttgccgccgcctttgcgataatctccttgtcaatctccaagtcgctctggtaaaagcctgtgttctgcttcataaccgcattgagggaagcgaacaaatccacgttctcaaatttactctgtttcggcatgggtcagctcctttccaaatcctgtaatttctgctttgcgtttttcttctgcgccttttccttgtcagccctaagctgcgcccggatagagggcttcttttccggcttcgcttccttgccgcgctctttgtcggctttgaccgcgttagccaggtcaacaagggaaattgtttctcccgccttaacctttgcttccagttcgtcaacggtaggggtgttgttgatgataccgtcaaagttgttgtcgttctgctctacggtgtcctcgatatgcttcaaggggtttgccttttccggctgctctgcggcaacagcaaacgcccgcgtcccgttccccataatcagatactttccgtcgtccgactggtggtgaaagccatatccggcggcttctatctgctcccggctcatggcggtcacatggaaagtccccctcggtgtctggattgtttcgcccgttgtcagctcgtccggggtaagctgcttctgctcctgtaaaaactccggcacttgccggaagcctacgctgtcaacgtaatgcgcggtgtcctgtccgttctgatgaagcactaccacgtccgaaacggaaaggctgtgtcccttaaaatcttttgggtggtcgatattgaagcgggtataaatatcttcaagggaagtttccggcgcaaggggcgcggaatagacaagctcatagttcgctttatcaaccacatttcccgccgcctgcaggcggtcgtaaggctcaaagcggaagtcccttgtttcgtccccgccctttatctggtaaatggaaaaggtgtccttgtcctgtccggtggtctgcgccgtttcctgtgcctttgcgtaaagctgctttacgtcgccctcggtcagctcgccgcttttgagctgccccataagctcgcggcatttctccggcgttcccgtataaagcacgtcgcccattttcgcccgcccgttctcctgtgtcacataggcttgcaagaggtggctgttttcccggctgtcgctgtaagggttccggcgcactctgtaaatcgtttccggggtaaaggcttctttcggggctgcttccggcttttctttcccggctgtatctgcttttttcggggcttccggctgtggcgcggcttcttgtccctctctggtgggctgctcctgtccggcggtctgctccttgtcctgtgccttttgcagctccgcaaaattcgcgtctatggaattgataatctcggcggctgcgctgcgtatcgtttcaagggagcttttcagctcggacagctcccgcccgctgctccacccggcgacatagccgaaagaatagtccgacgtgtcaagcccgtaatgttggcagacggtataggcgacgctttccgcttcgacttcgcgggtgcggcggtcaacgcggggttgctcgtcctttggcgcgttgaggtcaatgtcgtgcagcttcgcatgggcgatttcgtgaatggcggtctttaaggtctgtaattcgctcatgccctcgttgatagcaatgcgcttgtcctccaagtggtagtagccatgagagccgccctcgatattctcaaaggcgataggaacgggggaagtcttttcaagggctgcgaaaaagtccttatagcggtcaacgtcgcctgtcagttcgtcaacggcaatgtccggcagttcctttccctcggtctgggaaacgtcaaagacggataccaccttgtaggcgggtatggtgatttccttttcctcggtgacgggctttccgtccttgccgattatgggcttctgcgtgtgcgggtcgattttctgcatttcctgtttgattttatagggcgacggggcaatgattttaattcccttttgccctctcatcacatttcgctcaaagttgttcttccaagcggaaaagcccgccaaaagggaagcgtccggcttctgcatggcgataaggacggtgtttcggaagctgtaattatggaattttgacatgactttcagatattccttgtaacgctcgctgtcaaagagttccgtaatgccctgttccagacggtcggtaatctcttttaatttctcggcgggcttcccggctgtcagcacgatagggataaccgggtgcggctcctgtggctgctctgcggcggttcgggcggtctgctctgtggcggctgcgtccataaaggtcttgtcctgtccgccgcgttccggctgtgggaagctcataacgcggtattctttgggtatctcgttttccgttccccgataccattcggtaaaggtgttctgattgttatagatatagccctgttcggtaaactgccccttatccttgctaactgcgtcccgcccgtattcttcatacttgaaatatttctttgcttcttcgggaagctccagctcgtccagttcgtcgataagataataaccgtaatcttcttcgctgcggacagtgggatagagccagtaacagtcaaggttttgtgcaaggttgataaggtctttcatgcttccggcatactcgccatgtgtaaccgccgccgcaaatttatccttgtccccgtcactctgcatttccagaagttttccaaaataattcagctcgtccatgcttgcgctttggataacggaaagcggcaagtcaaaggggcagtcctccgtagaagaatacccgttgatgaaaaaatcctgcggattgtctgcggtaatgccgacgctttccatagccgcatgaagctgctctgttgtggtcggcatgggaagccacacgccgcccggtttgcctgtttcaaagcggctgcggctgtcgataagaattgaaaactgctcgtttatggtttcacgctcctttctctgttcggtgtcctgtggcggctctgctgtggtgggggctgctttttcagcggtaggctgcgcccgttcctcgccctcgatagcatagcccggtaaaagctgcccgtttactttgaaatgctctgcatactctggcgggataggcggcgatacctcggtgaataaatgctgataggctttgatacgcccattcagatatttttccatagctgccttgtctgcaaagactttcctttcctgtccggcgatttttgcctgtccgtaattgtgggggctgttggtgtaaatactccatgaaagcgtccacgaatagggaatggatttctctttttccctgtcataccgggtattctcggatatgtggtagcgcatttggtagacgcggttgctgatgtgcttcccgtagtccgtagcttcccactggttcgcggtatgcgtagcttcgggtgtcctcacatactcaatggctttgtcaatggcaagggtctttcccgcctgttcgtcccatgccgccgcctgttcttgcaaggcttcaaaagctgcctgttcagccgccgcgtattcttcccgcaatgcctgtaactgttctaagggcagggcggtaagcccggaaaggtcagcggtctgttcctcaaaataaatatttcgctctatccgcatactgtcagccgggtctaacttgtcacgctcaaacatggagtaaccttttttcttttccattcattcgctcctttctgaaatggcggcgcaccgccgcgcttttggggttcgccccgtactacggtgggctgtgcgttatgccaacaattttttcatttttttagagggtttgggaaacttcccaacaagcaaaatccccgtccggcgcgtcagcggcaggacagggatttacggaagtgggtacccgcttcctatgcttgctattcaagtttttagttcttctgtacttcgatacggtagttgacgtatttcccgccagtgtcagccagaacgatagttccgtcataggtcttgcctgttttcggggaatagagcttcttcacattcactttgccggatttaaggagcgcggcggcaatcttcgcggaaaaagcggtcttgcgttcctcgaaaaagcggtcattcttccacatgacaaaggcacattctttgttgctgcaataatagtttttcttcccctcatggacgggggaaccgcaacgggggcatttgccgacagagggcttttcctcccggaacaaatcctttttcccgtccagtgctgcggcgtgtgtctgcacaagctcccgcgccatagcttcaatgccggacagaaattcgccggggtctgcggctccctttgctatctgcgtcagattgttttcccattctgcggtaagctgcggggaagtgagcatatccggcaagactgatataagggcggctccgttctgcgtggggataagctgcttccccttgcgctctgcaaagccgccctttaccagtttttcaatgacggcggcgcgggtggcgggagtgccaagcccccggcgttccgcgtccgggtcggtgtccccgttcccggctcgctccatagcagagagaagcgacgcttcgctgtggggcttcggcggcgttgtggtatgctccgttacttttgcggcggggttaggaaagttctgtccctcggaaagctccggcagcgtcacgccctcattttccccgtcctctgcttcgggcttatctttcagcgtcgcccggtatctgcgttcaagctctttccaaccctccgcaagtacggtctttccccttgcggtgaagtctgtcccggcgcatgagaaaaccgccgtaaccgcttcataaatatgcggctcggcggtggcaaaaagcagacgcgcccccgcaagggtaaggatattcttctcgctttccggcagcgcgtccgggtcagcctttgcaagctccatagtgggaatgattgcgtggtggtctgatactttcttgctgtctaatacctttgcaatctccggcgtgaagtccgcgcccgccataaaggggagcttttcgcagagcagcgcgataatgtccgctgcggtgccgcccatgtcgtcagtaagaaagctgctgtccgtcctcggataagtaaggagccgcttttcataaagggattgtgcaaggtcaagggtctgctttgcggtgtaaccgaaaatgcggttcgtttcccgctgcaaagaggtaaggtcaaagagctttggcggggctgcggttttcttctctctggtaagggaaacgcataccgcctttcccgcttcgcaagcccctttcagcgcgtcggcttctgccttgtccgaaatcctttcgcttgccgcgtccgcgccggataaatcaaggcgaacatgataatatttttctttctggaaatgggagatagccgcgtcccggtcggtgagcatttttaaggtcggggtctggacgcgccccacgttcaaggtctttccatacaggcaggagaaaagccgggtggcgttaatgccgataagccagtcagcctttgcgcggcagagggcggacgcaaagagcgcgccatagtcccgcccgtctttgagggaagcaaagcccgccttaatcgccccgtcctccattgaagaaatccacaagcggcgcatgggcttcttgcagcccgccacttcgtagacaaagcggaaaatcaattcaccctcgcgccccgcgtcacacgcatttaccacttcggaaacgtcggcgcggtgcataagctctttaatggttttgaattgcttccccttgtccgggtcaacggcgtactgccattcctccggcagaatgggtaagctgtcaaaactccattttttatattgctccccgtaggcggcagcttccgcaagctgtaccaaatgcccgacgcaccatgaaatgaggtagccgccgccctcgatatacccgtcctgtttccccttaatgccaagcgcggcggcgatagtctgcgccacgctcggcttttctgcaatcacaagtctaaatgccatgaaaaaatcctcctttcagcgttccggcgcggtgtgcttcttctcctgtgcctgtttcagacaatagccgatacagggggattgcgccttataagggcaacgcatacacgccggggattttggaacgggcggcgcactgtcacgccgcccggtgggtctttgtaccatcattttttctaaagggttttcggtaaaaagcgtcatgcttcctcgtcctcctgttcttcatcagaaagcccgtccccctcgtcctcgtcgtaatcgtcaaaatcgaaatcttcaaggtcggtgtcgcccttgacgttctgctttggcttcataaacttaaaataatagaacgcgcccccgccgccaagaagtgccacgacaaggaaaagcacaagcccgcctgtattgcctttctctttgggctgctctgttggtttctcggtttccggctccgcttccttgccgctgcaagcggtcatgttgtccttgcagacagggcagctcacatttacctttccggcttcgcatttatcggtgcaactgcaaacggcgggcggggctgcttcggtgcttccgtcctccatgagtgccataaggtcggcttcgtccacttgattaaggaaatgtacggtgtcctcgccctcgtcgtcccggtcgataaggatataaaagtaattgccgtttttggtcgtcactgtgataagctgcttgttgccgccgaaatcgtctacaagggtcgcgttcccgtccggggtaaggggttcttccttttcgggttcctcatagacaacgccgctgtcgtcggtcgcgtcctgtccctccggggtctgtgcaaaggcggtgacggaaaagccgcccgtcagcatgagggcggcgcagagtgcggtcaaggttctaaggattttcttattcattctcggtgtcctccatttcttcggtgtcgtggtctgcgggttctgcggggtagcccggcgcggcttccatgcccggaataccgccgccggaaagcatagcggaaagctcatgcggggaaaggcgcatggagcgcacaagctgtacgatttgcaggttttccgcttcggttttctgcgcttcaagcccccttaatctgttctggtactcggtgattttctcgcgggtctttgcaatctctttgtcgatacgttcaattttgttcatagccatcaataaatttctcctttctttgctcaaaaatatgttaattccagttcatcagcccatagcctttgatacaggagtaattgacggggtagctctttatcttgcaggcgtcgccggaattgccctcgacggtatagacgcgctccccgtccgttccgataacaagccccacatggtctgcgctcccgtccccgtcccagtcgaaaaagatagcgtcgccgggggcgatattctcatagcccctcgcgccccattgcccgcgtgactggaaccagggtacgccctgtgactggcacccggcaaagcgcggctcgctctttccggcttgattgtagcaccatgaaacgaaacaggcgcaccattccacgcggctgttaaatccgtaccagctccaaaagggtcgcccgcccacgttgccgacttgccgcttcgcaaggtctacaacggcggtgttgccggggcgtgtgccgtttacaagctgtacgccgcttaaatcctcggacgcgcccatatcgggggagccgccgccgaaaatcagcggtttgtttccgcttgtttccagatagacgcggtacatttcaagctgctgtggcgttagaagttcctccgcaatctcggaaatgggcttgttcgtcagcttcacgttgaggatatggtactcgtagggtacttcctcggtggtcgtttcccctgtttccgggtctgtgcttgtttctgtgcggtagcggatttccgtttcttctgtcagcgtcaaagtgtactgcatggcaaagacgcgatttagctctgcctgtgcgctctgcggggtgtaggtctgtaaaagggcggtgaggtaggacgctaactcatgggggttatgcccgatactgtcaaggtcatagcggtattcgtcatagccggggtgggtgctttcgatattgtcaatctgctgctgaagctcgttttcctttgcggcgtaattgttctccgtcgccacaaggtcgctgtcctccgacgtgtaggaagtcccaagtatgccgttcatcaagccggagaacatggaaccgcaagaggaaagccccgccgataccatgatgaataagagtagcgcggcaacggcgatacatacgcccgccgggtgccgccctacaaaagcgattgccttttttgtttcctcggcggtcttttttgccgccttgcgggtgttctctgcggctttctgcgccgtttttgcgccgcctttccttgccgactttgcatactgccgcttgatttgctgcttctgcatgaagcgggaaaggggattgcccgcaatctgcggattgtcatgcagggctttatggtactgaaaatccacattcgccttgaacgccgctttctctgcctttgccgccgcccggtagggtttgagcttgtggctgtggtagccctccttgactttccgcgccccgtactttgcgccgcgctctgccagttcttcggatttgtgcgccccctcaacgccggaattgtccttttcaacggaatgtatcttgttgtggacgaaaatacccgcttcctgtgcggggcgggatagcgggttattgtggggcttattctttcctatgggcttttcctgttcctcaaaatgtaggcgggtcttgcctttcccggtggcttcatcaaaggtgcgctcccgtacaagtttcttttctttggggatagccgcctttgccgcgtccagacggtcggctgctttgtccgattttcggatatacctttcaagctccggcgttgcccgttcctcgtcggtaaactgcaagcgggaagatttttcttttgctgtggcttctgcctgtgctttcctcgccgcctttttgctcgcctttctggtacgcgccccgtcgatacgttccaagacgcgctcggctgctgcggtgtcctgttcccgttctgcccccggcgcatggggaagcggcggcgtgtcggttaagggcggggaagttgcgccgcccggtaggggctgcgctgcctgttccggctgcggtggggcttcggtctttgcaaagtccgcgtcccttatccgcttgctgatacgtttctttttcccggtagcggcgtttacctcgacagccccctcgcgggtcattttctgcgtgactttttcacgcgccttatattgttttatgtgtctgtccctccaatccgcgcccttgcaagggcgcaatactcggcgtttatctcaatgcctatataatgcctgtcaagctgctttgcggctgcccccgtcgtgccgctgccgaaaaaggggtcaagcacaacgccgcctttcggacagcccgccttgatacaggtttcggcaagttttggcgggaacgcggcgaaatgcccgcccttgtagggaacggtattgataagccacacgtcccgcctgttccgcatggtcggcatgagggcttcgtcgtagtagctgccgcttcgcgcccggttaagcccctgtacgttcccctgtccgggtacttcgtccgcatatttctgtcccgcgctgcgcccggtgcggtaccgcgccgccgttgtgggggctaacggctcggctatggcggctgcgtcataaaaatacttctttgacttcgtaagcagaaagatatgttcatagcagcgggtagggcggtctttcacgctctccggcatggggttttctttctgccagataatgtcgctccgtaaataccacccgtcagcgcgtagggcaaaggctaaaagccaagggataccgattaagtccttttgtttgcagccggaaacgcggttgtttcttgcaatctgctgtccgtttctgcctttcgggttcttcgggtctgcatggtagcctttatttcctgtgccgcagtaggtgtccgcgatattcagccagagcgtaccgtcagaacgcagtacccggcgcagctcgcggaaaacctcggtcagcctgtcaatgtactgctccggcgtgtcctcccgcccaatctgcatatcaagcccgtaatccctaagcgcatagtagggcgggcttgtgacgcaacagtgtacgctttcctctggaagctcccgcaaggcatagagcgcgtcccggttgatgattgtgtcagttttcagcccgttcatgcttcgcccacttcctccggcttcgtcgtcattacccggtaaagctcggtgtctttcgggaagcggtctacaaagggcagcaccacgttcccgtagaagataagcccctcgcccgcttcggtgtgggtgacatacttcatctgctgcggggagatgttgagctgctttgcaaggatagcccggtcgcccgccgcctgattgagcatgaggacaaaatcagagttttcaaagatattctccacttcgcgggaagcaagcaaatcgtagggtagggtaaaggcgtcttgccgccgttggcggcaggtttcctacaccctccctcggaaccggacttactcctctcgaagtatccggctccccattagtaattgacgtattgattagtgtttgtgtattctttcatggcacttgctacaaacaacaagtgttttccgccgcttctttttcatcacggtttcccaatcagaattccccaactcgtttaggttccgtataacgtgaacctcgtacaagtcggcttctttacacccacatagttcacaaactctggcattaagccgttgtctgatagtggttttccagctaaatttctttctctgatagatgatgtcactcgcttcgccacgcttacaatctgcgattttaacagggcgtacacgttttgtcccagctttggtttcataaggaacagaccacgttttcccgtctttgtgctggcggatgattttgcggatactggttttatgcttgttggcaatcgtctttaagcagctatactccatgagatagcagaagtagtccagcgtgtgatagtcacaggccagattgtaatagttgcatagtcctcttgcttcggcattgtactgctccacaatctcataatccgcaaggttgagaagtccggctctgtgtatcggctggaactccccattctccttttggcgaatgactttctttgcaaacataaatttctcaatcttttccgtatggggaatagtaagggcaactttcatgtgcagggtacgggattttctccacgtcccgtttttcattctgtgacctttgacctcctgatttctgcggacgcaaatatcatagccaatgaaacggactttttcggagctgtgcgttatcagcgtcttttcttcactcaaggtcaatttcaactctgtgcttagaaattcagcgatttcggtttttaattcttcacattccgcttttgtgccgcacacacctgccagccagtcgtccgcatagcggacaaaagtaaatttcttattgtcggcgggtttgcagggcagatttctcatagctttcttctgcgctttatgctggtcaatcagttcttgtctttccgcttcattatcggtatggtcaatccagtaggacagcctttttaattctttgcttgccgtatgatattccggtgtctgatatgcggacctcggtttatcaaagcgttctgcgatttcccgaaacttcttgtccagctcattcagatagatatttgcaagtatcggtgaacagataccaccctgcggagaaccgctgtaagtggcgttatacttccaattctcgatatacccagctttcaaaaactggcgaatgatgttcagaaagcgactgtctttgattttcctgctcaaaatctcaatcagtttttcgtgattgatgttatcaaaacaaccctgaatatcaccctcgataaaccaaaccacgcctgtaaagtcagaagaaatctgacggagtgcggtatgacagcttttgcccggtctgaaaccgtgggagtgactgtcaaagacaggttcatagatagcttccaaaatcattctgacaacttcttgcaggagcttgtcacggaaagacgggatacccagcggacggagttttccgtttttctttggaatatacccacgtcttacagggttagccttgtaggttccgtcctttagtgactggattaactcttttacatagaagtcactgaaaccgtctgcggtatcgtcgtcgataccctgtgttgttgcgcctttgtttgcataaagtttctgataggcggcgtagtaaatatcttcacggagtaaatatctgtatagccttgtgaatacgccgtctttgtgttcgctggaacacctttcaatacgctctaaaatttcagatgttggtttcattgaggtttctcctccctttcattcttacattttagatgttactaactggctcccttcgccatgtaagggtcattacccctctcggactactatggagcctccgttaccatatccggcgaatgagccggacttaggcaatccccagttagcgttgtgcttaggtgaatgaagattgtcggatatgctttcggttcgttatgacgtgttctcacgcctgtttcataacgtgtagcagttgtcccgccgtgaaagatgacgtgacagcgttatgacatgggttacaggacttttcccacacctgcaaaaaacaggaactggaaccttacattcgataaacccaatcttatcctcatatcttcttaacattaggaaacagtcgcacctaagtcctttggtgactattcctttttctgccatgcgctgttcccgtaaaggatttctccttagtcggtaaggcagattgtttcgcacactgccgtgtgcggcagtaccttaaactgctttgcacaacgccctatctgggcgcactttgacgttctgcgtgattgctgtgggtatgccgccccattttctgaaacgcttccagatttcaacggaataggcggcggtctgttcctctttcaagagaagatgaaattcgtccataaaataccgggtggatttcctttctgcccggttgacggtgacgcggttccatacctggtcctgcacaatgagcatacctaattttttgagctgcttcccaagctgcttgatgtcaaagcagacaaggcggtttgaaagctctacattcgtcctgtggttaaagacgttaaggctcccggaaacataaagctccaacgccgccgcgatacgcgccgcttccggctccggctgcttcaaaagctcgttgtagaggtcgcccaagataggcattttctccgggtcggggtctgcaaggaaagggcggtacacgttcctaacagcgcggtcaatgacggtcttatcgacgggctgcaagccctccttgccgcctatgacaagctcgcagagggagaggataaagtcggatttcagcgcaagggggctgtcgtcctcgctgtaattgaggttaatatccatagggttcacatactggggcttcccgtcaatgcccttgcccgtaggcgataaccgtatcacttgcccgtcaagccgctgcacaagggaaaaatactctgcttccgggtcgcagataattatgtcgtcgtcggtaatgaggaaagcgtttgtcatttcccgtttggcggcaaaggatttcccgcttcccggcgtacccaagattaagccgttggggttctttagctgcttgcggtcgcagagtatcatgttgttactaagggcgtttaagccatagtacaaagccgcgcccgtctgaaaaagctcctgcgtgataaaggggataaagatagcggtgcttgacgtggtaagccctctttgaatggggataaggttctccccaagcggtacagaggacataagccccgcttcctgttggtagtcaaggcgggttaaggcgcagttgttcttctgtgcaatgcccgccgccgcgaatacgtcattttccagtttcctttttgtgtctgccatgttcaccacaaggaacgtcaagaggaacattctttcattccggctctgcaagtcctgtaagaggttcttcgcttcgctgccgaaagtggcaaggtcggacgggattatatccatgtcgtagccgctgcgtaccgcttttttctgttcttcgattttcattttgtcaaggtcggtgattttccgcttgattgtctttatggcttcggtctggtcgatactgtggatatgcagattgacgataacgcccgtttccaagtccagaatgtcagataagatacggtcgtttaattccggcgcaaggatttcaaggaatgaaaccgcgccgattttgcgccccatgcggaaataccgcccctcgccaaaacggaaagaggacggggcgataaagtcctttgtggaaagcccggacggggcaagccatgaaaaatcaaaggcaaactgcccgccctccgggtggaaaatgccatgcagcattttaaggcgttcatagcctgtcatggggcgggcagacacgcccaagagcttaaagttgttgagtacgtccgtttcgatacgggcaaggcgggatttcgccgcgcccagactgtcggcttcaatggcaaaggtgatatattttgctttgacaagcccgttgttgccctttgcaagctggtttttcagcatatcccggtattctgtgcggatagaattgaaagcgtcctcctgtgccgggatattgaccgccttttccgcttcgccgcgctgcgtcccctgattgatgaaagagagctgcaccgaaacggaagcgtcaaagtagttgaggaagtcgcaccagttctcaaaaatggcggtcttgtcgtctgcctgtgcaagctgatagttaatatcttcaaaggcgacggtctttgagtatttccgtcccgtaaccttgcagataccgtccgggtacatctggatataagggattgtctgctgcgcggtgtgcgctttcccgtcgccctttgcctgtctgatgatttccgcaatctgctttttctcggcgcgggtgagcttgcggggcgggttaggctttgcgcttcccgccgcgctgtttcttcgtgtttccttttgcaatcgctgatacctccttttcaagttttctctgccgttctaagacggaataaaagttgtctgtcctgtatggtcgttctttgggggctatgaatttcgtctgaatgatgttcttcaccaccacttcaaggggctgtccatgcttctcatacatggcaaagaggaaacagggcagcatgacggcaatcatagccatagacgcaaggcttgtgcctgtgctgtctttgagcagaaagaaaagcggcaagccgaacaggagagccgccgcaaaacatacaatctgccgtttggtaaggttgaacgctacttttgtcttgactttggataagtctttgggtacgggtacatacgccaagtgaaaacctcctttctctgggtttggtgttgctgtaacttcccataagggtaatcaaggcaaaggtcaatctatgccctttgcccgcccgtattatatgggggttatccgcgtcaaggtcgggtcgtattttcgccgcttcgctctgaaaatctccaccctgcccttgacacgccgctaatgcgcggagaatatcgacttcgccagtgcgccggatttgaacagggagaaacagaggataacggtataggctgcaagggagaatatcgcgctgtgcagattgtccgctattatcatgttgtttaccagaaccgcgtaaatgccgacgcatatcataatgaggaagccttgaaaaccgatagcgaacagggatttgaggtagttgtttcctatctgcccccattcccggttcgtcattgttgcaaacgggataggcgataccgaacagtaaaggtaaatctctatcatgcgcccgtagaggataacggttatcagtacggacatgattttcatgcacaagctcacaaggcttgtttccatgacaagtaagagcagttcggggatttccatagcgtcaagcccgtcctgcatggaagcaagggcggcggcaacatcaatctctgtgctgccgccgattacccccgccgcgccggaaacaacgtgctgcgccatatcgaacaccgccatagtgatgtcaaaggtgtgcgtcacaaggtagactgccacaaacgccttgaacacccacttgaagaacatggaagtgtcaacgtcgtgcatattgttcttttccgttaccatgctgataagctcatagcataggacgtaggtaatgacaagccccgcaatgggtacgattacattctcactaagggtctgtatcatggagaatatatttgcgttccacccttgcggggtctgccctacctctgcggcgatagtgccgactttctcgtttacgtccccgaacatagttgacagattaccgtttatggctcctatgaggatttcctttatccattcgttaatcgcgtcaagtatgctctgcataagcctttacccgcgcttcttaaccgaacaagccggaaagcagcggtacaagggtcatgccgataagggcaacgccgccgcccgccataagctgcttcatgccctggctctttactgatgtgcgataaagaagtaatagaagtgtaaaaaattttgccgttcctatccggcacttagctcttgtgtcggacaggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccggacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggaggcttccagttcctttttcttggcggcgttcctgcgcttgcccccgtcctcgttctgctcaatcaagagcttcataaaccgggcttcatgctttgccgcatagcttgtcacttttcgcagattggagagtacaccagcggtcaagaggtcggtgcggataaagtgcgccgtacagtcatgggtgcgtttcttgtagttgccgcagatataacagtcctgcttgcgcttgtctgtctggtatcgctgctgatacatcacgctgccgcagtccgcacagaacagtatgccggagaacaagcccacttcatcatagcggttggggcgtttgcgctgcttgcgaagctcctgcacccgttcccatgtctgggtgtctatgataggctcgtggtggttctcgaaaatcacttgcttttccaggggattttctacactgtgcttgactttgtaagagagcttttctgtcttgaagtttaccagacagcctgtgtattcccggttttcaaggatatgcacaacggtattggtcgcccacttgcactcatagccggggtggtagcggcgggtgctgcccgtcctgcggtattccagcgtccccggcgtggggatttgctgctctgtgagcatacgggctatcttggtcggaccattcccggcaaggcagaggttgtatatctgcttgactacaggtgcagctttctcgtcaataatgaaattttcgtcctcgtccatgaggtagccatacacaggcttgcttgtgatgggcttgccgctcatgccttttgagcgttttactgctttgattttcttgctcgtatctctcaccagccattcgttaaagatattccgcagcggggcaaagtcattgtcgccttgtgcgctgtccactccgtcattgatagcgataaagcggacacctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgctttgcataggtttcaaggatacgcttctgattggaaatggaattgctttcgccttgcagctcgtcctcatgggatagtcttgggtaaagggcggtaattggttgttggttggtctgtcttaacataaaatcctccgtttccgacagccagccccactattccgtaccttgattgtaccacatggggcggcggtctgtatagcggtaaaagcgtcaaatctgcttctttatggtcggtcaaatcgccgttttttgtgtagcagcttccgcttccagcactttcatcatcttgtcggctgcggtatcggttgcgccctgcttgaagaagccggaaacggtaaggacggagttgcccatgcggatttctgttacacagtccgggcggcggtctgttttggtggtgcttgtctgtttcgtttctgtcataggctctcctttcgctgcttcatcagttgctttaatcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccacttcggtaacggctgtcaatcacgctgtaaacctgttccagcccgtattctgtccctcgctccataccgaaatcatcaagtatcagcagggggtagctgcaaaggcgggaaatatattcgttcctgccatcaaagctggcagcaaggtcattgagtatggttgcaaagtttgtcatacagacggcaacctctttctccataagggcgttggcgatacaggcggcaaggtagctttttcctgtccccacgccgccccaaaacaggtagccgatattttcagcctgcatggtttcccagctctccacataaaagcgggcggtttcggtctgtgggtttctgccgttgtcatgctcaaatgtccagttccgcatagcagggtcggtaaagccccggcgtttcaagtcctccactttttcaaggtgcttctgtcggctttcagcggcttcccgtttttcacgggctgcccgttggcagtcgcactctgccgggtgtcggtcatgccctaaccattgggcggtttcttttgaaaaataggcttctttgggcgtatggcacttgccgcagtataaaagcccgtcctcgcctgtgtagtcctccgcttcggcggtagtggctgtaatgtccgtaatcatagcttcaatctcgtttttcataagctctcgccctccttgcatgaataatcgggtatgccctgtttcggggcagccttgcctttggcagcgtcctcctgcgcccacttgtaaatggtggctgcatggctgtggtactgcttcccagtggaagcgatatggcaggaaagccggtcaatataatactcccacttgtcgggcagctctgttttcagcccggaaagctctgtatcggtcagtatcacattgttgtatctgccataagcggcgagggcggggtgtcccgtttctccctctctctctttttctatctttatctctttctctaactctatctctatctctggtggacgaatgtcggacaaatgtccgccttttgtccgggacggtaaaagtgccttgttttccagccttgcagcccgtttcctttcggcttcggtagaggactgtcctatcatcagttcaatgtcggtcatatagaaagccccgctgtcaagctgctccacaagccccaactgccggaaaatctctaaagccctttcaaccgtccctatctggtggcgggtcagtgtcgctatcatctgtgctgtgtaggggatatgctcgtcaagctgcaacttcccgccgtttttcagcgattttaagtacagcttcaagaggatattggaatataaaattccgtctttcatatcttccagcagcacaatggagtcgctgtcaaaaaagttttctttcagcttgaggtagtaatacttgcggttatctgccattgtccttgtcctcctttttccggcgtttggagtagtagcgggggcagagtatgataaccgcccggaagctctgcttgcagctatgggtacagccccggcagaggtcgttgtatgtgatacggtcgcaggtggtatttccgacttttacttgccgcaggaaaaaagaccattccagccgccgtttcttgctcattcttggcatgggtgcgctcctttctgccgtttccgctggtgtggcggtatcggcggtaattctgtatcatctcggtatcattttcggggtttttctgccctgtaagcccgttaaaaaatcctttggtattgcagatagggtacggggcagcccccttgttctgtatgggttcgggtacattttggggtggtttttatcgctcctgttcctgccttttcacaggcttgcgttcccggcgtaaaatctggtcgatattgcccttgacagtctgtaagcggcggtattcctcccgttttgcccggtaatcgttgtagccgctgtttttctctttgataaggctttcaatctttgcttgcagggctttatagctcggcagcttggaaatgccgttctccctgaaataacgggcggctgcgtctgctatgataaagtcgctttcgtgcttctgacggtaggctgcttttgctttggcgtttttctgctgtttcagcccgtcccggacagggcgggtcttggaataggcaagcacctgccgttgcagctcctttttcccgttcagcgtcttttccacctgcttcagctctgtaaggctttcctgcatggcggcataagcggcagaacaggcttcgtccagttcctccggggaagaaaagccatactgctgataggcggtaacggtagctgccatttgctttaggttgtgctttgccgcccagcggtcatagcccacgcccttgccctcggctcgcttggcttcccggtcaaccatgcgctgcaaggtgttgtctgccggggtggtttttgcggctttttcctcccgcaagcgttccttttgggtgtgtgggtattcgggtatgtctgtggtctgttcggcggctctgtgggcgttctgcgtgagcagggcaaggacagcagccttgtcaaaatcgtcccccagcttccgggctgtgataggctttgtcctgtccggcgtgaggtaggaaagccgcccccggctctccttgacggtcacgccctcccgcagcaaaagggaagaaaactcgtcaaagctggtagcttgggaaagtgcctgccgtatcgtccggcgcagcttcgccttgtccgtttcaaacttggtgggcttggtcggctgtcctgcggcttctctggcagcgttctctttatcaagggcaagctgccctttctttgccgcccagtattcccgttccgttatccgttccttgctgccgttcaaaagatcgatttggtaaagcccctcccggtggcacatctccatgacttcactcttgaaatattccatagcggcattggtgcagcggtgcttgtagccctcccgtgtgtcggctggtctgtccatgtagggcagaagcgggacttcataaatccgcagggagttgaggacgatatgcacatggatattgccgctgtggttatgcccgtccgggtgggtgcatacaagggcttggtgtccggggaaatgctctttacagaacttctcgcccagctcctgcgcccggtctacggtcaagccgttgtctgtcccgtcccgtgggtcaaagctgatgatatagtggtggcttttcacatcttcccgtttttggtttttctcatagcgaagattggctcgcatacaggcaacggcgaaatcttcgtccccgcagttgatggaagaaatgcggtaatcctccctcggtatcagccgcccgttttcatcaagagtgggcttcatggtaaactcgtcatgctcaaatgtgagataggcttccgctgcgccatagtcggcatttttagagctgatatgtttgaatgttgccaacagcgtcacccactttctgcaaaacttcaaactttagggcagcaaggtcggaaaccgccgcccgtacctcccctgcaagctgcgggtaggggctgtgccactcgttcagcgtccgggctatctggtttaagttgccgccgatcctgccgtattcggcggtcagtttcccgacagcggcaagcagctcgtcattgacaggagaaacggttatgatggggcgtatggctgccccggttatggcttgccggataaactcggcttggctcatgttgtaagcagaaagccgttgggcaaactcggcgtattcttcctcggtcatgcgtgttttgactacccggctgcggtgcggtgtgttgtatcgttttcgcatggtaaaacctcctttctgtgcgtggtgtcctctcactaataggagaaaaacggggtgtgaagcggaactgtttttgaaaaatccgaaaaaatattttgaaggatttttaagcggcgcaagccgcataagcagggtttggggaaggcactccccaacaagattcccgcaggggcaaaatgagcgaaaagcgaattttggtactgcggtagaatcttgctctaagaaactgccggactgccgttcacttgctactgccactttttcgggaaatctataaccagcttttttataaaaggctgcgggcggcgttctccccttactccctacaacaccgcaaaaagcaaaaatgacggactttccggcaagaacttttccggcggctcggtctttcccgacaataaggcgtctgggaagctgtgttttgcccgctgtctgaaaaaaacggcagccttttttggcttcactgtctaatacggaacttttggaaatttgccaaaaatggacgcaaaaaaagcagcaaatctttttcggatttactgcttcatgtgccgctgcggtgcggcgggatggatattcagttgaaataaaagagaatggtggtactttagtctatcgactctttactaactattaggtaatcttgaaagattttccttgaatttatctaaagaatgttcattgtttcccgcaaaaataagtggaattgtatattcatatgatatgccattttcatagtccgataattgtatttttatagtatcatccctctcatctttaggtgctatatatatgaatgaatttttatttatatcagatattttccctttttcagaagaaacagtataaccccagtctgttaaatttgtctttattgtaacttctgtttctgtttcttttctagtctgcaatgctgttttatcgatttggatatcaaaaggagtcgaacctaacaattcactgtttatatttacaagttcttctccatttgttttagaaatattagattcatcttcataattttgttgagattcatcttttggtgtttctctgttacatcctaataaaaagcataaaataattagtactaatacagaaagttgttttttttgcatttatttctcctttcatattatcaaagaaagcactgagagtactttcaagaaattttgaaatattctcaatgctttctattttttgattataaacttgccggtaatgatactatgttaatttatctctttcgcgtaacctttgttgcaatatacacatgcaccattcacccatttgtgagacatttcaatcgtctcaacttcataaatgcttacttctccacaaattaaacattgtttgtaattatatacatgacgtgtcgcacatttatcccagtcatcatatataccaggcatttcatcttcatatccatagtactggggagaaccccaactatgagtatgagcggcaaatacagtcattggagcagctacaattccagctactactgaaagtgctaaaatagattttcttaaattcataagttcctccctttccttaaaaatacatagctctttgttacattgtcattttaacataataattggtaaaatgcaataatttattttctatttacgagaaaatactgtgcatattatcttatttaggaatagttaaggcggctacctaaatctttttattactttaccgcacatgagcattcgcgcccggattgtcgttgccgtagccctccatgagattgataacgccccagataccaagcccggctccaagtgctacaacaagggtctgcaaaacgtctactgcgctattgaaaaatgccataaataaatcctttctgccgcgtctgcggctgtccggcaagcggacaaaaggcggtcagcgtatgccgccgcataaaaaaaccgccctctggtaaaggcggctgtccccgcgctgcgtaagttctgcggcgcggcggtattcagttgtaggggggtgcggctcctgccgctgtgtgctgcgccggaaagtaggggcgcgtatcatgtagccgatattgatatatgtgattgcttcgattcctcctttcggtgtcccgctgtgctgccggacgggtattattcagacttgcgggaagtgaatagcttgcatagcaaggtgttcgcttcccgcaagttcacaaaggggtagctgccgcaaggcagcgtaggggaagtgtagcttcccctgtcccccccctccccggcggtctgccatgctgtcactgttgagggataagcccccggcgcgtgacatactccgttgcaaaacggcggtgttccgcttccttttcccgccaatactcccataatgcagcgtcggcggcttccgcaacattcattaaaaaccgttcaagctgcttttgtttttcctctgcgctacgtttcctcatggtctgcgtcctcctgtaagtctgctgcgtcaatctcgtaatagtcaaaaacctcgtcgggcttgacaatggcggggcggcgtttaaggtgcttttccatgtcaaaggcgttcttcgggtctgcgtcggataggtacttgtatttcgggtgtttcgttatgtcgaatttgtccgaaaagaacgggcgcaccccgcgtagctgcaagatacatttccctccgtccatgactgcgatttcatcttccgtcataagctgctttcccaatttctgatagttcagcccatgcgaaagctcccgcccccttgtttcggaagtgttgaagctgtctatcgtttccttgcctaaaatctccgatatttctttgagcgtggttttttccttgccgcccaagaaaagcgtggtgtcgcagttgccgactatggtatcggcgttgtccttgtagattgcctttagctgtgactggctctgcaagatgattgacgcggagatttcccggctccgtatggttgcgattagtttctcaaatttggggatttgcccgatattcgcaaattcatcaagtaagcaccgtacatggacgggaagccgcccgccgtattcatcatctgctttgtcgcacaagaggttgaatagctgtgtgtagagaatactcacgacaaagttaaaggtgtcgtcggtgtcgctgataatcacgaaaagggcggtctttctgtcacctatggtgtcaagctccatttcgtcggtttccataagctcccgcagctccttaatgtcgaatggggctaacctcgcgccgcatgagataagtatgctttttgcggtcttgcccgccgccagtttgtattttttgtactgcttgactgcaaaatgttccgggtctttttcttccagacgttcaaacatgaggtcaaccgggttctggaaatcctcgtcgtcctcgcgggcttccgacgcatttatcatttcaagcagcgtcgtgaagttcttctcgtcctctggggcttcataccagatatagccgattagtgcggtgtagtagagcttttccgctttcacccagaaatcctcgccggatttttccccgtcgcctttggtgttggcgataatggtattgactaatttcaaaatgtccttttcgctccgcagataggcaaagggattgtatttcatggattttttgaagttaatcgtatttagcactttgatacggtatttgtaccgctgcaacattttcccggtttccaaaatcagtgttcctttcgggtcagtgacgatatacgacgttggaaaatcctttgacgtacattgcatgagcgacggtttcacaaagaaccgggtcttgccgctgccggaaccgccgattacaagaatatttttgtttcttgcgtatttcggctgcttcgggcggctgttcatggtgagccgttccgtctgcgttaaggggatattgttctcaaataccgggtctgtgtacggctttatgtcgtcagccccgccccaacgcgccgaaccgtattctgtcccgcggcggtatttcttcgcgttcttgcctttggtgtagataatcagccggacaatgaccgcccccgcaatgccgataagtaagtctgccgggtggaagctcggcgcgatactggaaaaggcggtggtaaaaccgtccccaagatgtagcagctttgcgcttgcgtccgcgccgggggatagacggacagccgcgcccactttatcaaagagccagacaaagagcagatacgggagatttaggataagcagcttcttgatttccggcttcatagcgatacctccctgtccttgttcttgacctttgcccgttccgcgttcttgccctgtgcggcttctttgagcgtagagagcagctttcggatagagggctttttctcctgtgtcagcttctttgcggaaaactccttaaaggctgcggtcagcacgtccgcgtcccgccccttgaaaaaaaccagatagcggggcgggctttccgttgcgtcctttttcagcgcaaagtcgataccgtactttttcgccgtactctcaaaggctttgatattgccctcggtaatctcaatgttggaaacgcccgcgttctgcttcataagctgctttaagctctgctttccctgtggcggttttgcaagctgctttttgccctttgacagtatggctttcattgccttttggagcgtctgggcggtcagcttcccggtcttgatgtaaagggctatggtcttttcgtttacttcgtcctgcaattcctcgcgtcctcctttcgcgtttctttatggggcggcggtcagatacgcacccgcagcccgttcaagtcctcggctctgatacccacaagataccagttgtcgccgtactcaatccgggtcggcttccacttgccccgcacgaatacgtcaaagcactcaccgcaatgcaagcccccgtagtagctgtttaagtcaaagcgaatgtcgtaacggtcggtgcgctcgtcaaataccaatgctcctgtcattttctgtgccataataaaatcctccttttgttgttttacaggctttcgcccggtttgaatgaataatagtccgggtcgccgtactgcggcttcttcggtgacagtgcgccgcttgccatgtcatgggcgacaagggaagtgtaataattgccgatagtggacggggcgttgaaaagggctgctttcagatattgcttgatgttgcggattttcgttgtgttctcccgcatacagtcaagcacaaagcggatatgctcgccgtccagtttcataaacttagatttcacaagctctgccgggtagtcgtcccccgcaatccgtacccgctttctggcggtgcatacggtttcaagcatgaggtctacaatctcgtccagcctgtccccgtcaaacttcatgtcctgtttgagaatgtggtagtcgatattgtccttgatgatttcccggtatatatcaactgcgctctgtgctgccgcttccgttcctttccgttccggcggcgtagccgcttctctgcaaggagaggggttaggggaaaggataggaatggaatgggtacttgataaatctgtatttgatttttctttttttggtaagtcagttctttgtatatctttatttaattgcgttggattttccaacgtaggtttttccaatgttggtttttcctgcgttggattatccaatgttggattttccaatgtaggtaaatccggcgtaggcggctgcggctgctcgaatatcacatagtccgcgccccgcaagcgtcctttctcgtcgcgctcccttgaccgaacgatatacccggcgcgttcaagctccttaatggcttcgcggatagcgtctatcttctcccggttgataagggataagcctttcaaggtgtagtcccaatcttcggggagtgacagcatttgcgacaacagcccttttgcctttaaggaaagctccttgttgcgtaggtggtggttgctcattacggtgtagcccttgttccgttccactctgaaaactgccatagtaaatcactccttttgctgtggatttgttacgcagtagaagcgcggtttcgggggataaggtataaatcccttgccgcgccagatacgcgcccgcaaaatcgcttgtagcaaggctttttctgcccctactgcgtaacaaagggcataaaaaagcggcgttcctgttctcccatgtagagagtaagaaacgccgcttctgcgtcgtattcagtttttagtacaataccctgcttgtccgtcgctcgaaaaaccttgattttccagtgttttcaaaagtatcgttatctaacgtcagctttatttgtgcctgtattctgctccttctgtacaggaatcgtaatttcaaccacagccccatatccttcatccatattggaaaaattaatttttgccttttctccgtaaatcagcttcagccttttcagggagttctggattcctatatgcttcctgtcattataatatataggcgtatcctgttcgatggcctccaggatatcagggggaaagcctgttcccgtatccgatatgcagatgtacaggtactctccgtcctcataattttcattcactatatagagggtgatttccacgtgattatccagagataccgcatgggttatggcattttccacgaaattatgtatgatgagcgtgggaacgaggtaggtatcgatggtatcttccataatcacttcaaaggagaatgcttccttgccatagcggatctgctggatttccacatagttgcgtataaatgcaatttcttccttcagggatcttggctcaaaggtatcgctcatgacatagcgcatataattggaaagcatttctgtgatatgcacaattttctcttccttcgccacatccgccattccgtggatcaggctcaggcagttaaggtaaaaatgcggtctgatctgtacctgcatggcttccagctctgttttctgcctggccagttctttttcatagatgtcaattttcagagatttaattttgcgcagcagtcccttgaattccttgcttgccatttccagctccaggatgttattactgccgttttcattaatccactgttcctcttccgtatttttcaggctgtttacgaactgcttcatagggcgcaggatacgctggtaatagactctgactaccaggatgcagccaacgataattcctatggcaagaaaaaccaaaatgacctgaaggcgcattattttttccagaatgccgccgctgggggttatcatgatatgaaaaaccctgttttctccgataattccgctgataggaaaggagtaaatcacctgttccgtaaaaatgcccgccttttttcccgagatattccggatatcctccacacttattttatccctgtccctggaagaaataaatatggagccgtccttatcctgtatatacggaattccttcgtatccaaggctgtctattcggagagtgttaaacagatcctccaggcggattgcacatcccattgtcataccatttttggaaaaacggctgaatacataatcctgttcgccgtcattgatgaaataccactgggaataaggagtgcgttcccccttcttctcccggagggcctccatcagcgcactgttcaggcccagcttctggctgtccttaaatatactgccgctgtccgttatcagcagctccgcttcttccagatacacaaaaaagcagctgggttccttataacggattttcagattccggttctgctcctggatctcattcaggaccggataatacttactgtcttccggcctgattcccttaacggaatttatttctctttttttattggtcagagtgatgatctcataattgattttggtgatatcggtattgagctgctccacatacagtgcggcggtatcctcgatataacggtataccagctgccttgcttcaaacatgctctggaacatgactaccaggatacccaggaataaaatgataacaggaattatgacctgtatggtgagcttccccatacttttatttttcttctccgctttccctgccatatctattcctcccgtttatacaaacagcctggcaggactttgcaattcaatcgttcgcttcccgccaggcatttcctttttttattatatagctatatggctataaagcaaagcaccgaaatatccttgattcagcggatcattttctttcggttctttcagaaatctatactccagctgctgtctgccctcatgaataccggtattttatctatcggagcatccacctttactgtctgtccgccctcgtagctgctgccgctgaatacatccttccaggtgcatccttccggaagataaacctctctctcgtataaatcttcctccatcatgggcgctacgcagaagtcagggccaaacatataggcatcatctgtttcccaggcttttttatcctccgggaaatcataaaacagcggccgcatgatgggcgtccctttttcatgggtgatacgcatctgttcctttatataaggtttaagcgtttctctcaaaaacatgtatttcttacatatttcaaagacttcctctccgaagctgtagacttcattatccgcgccggaaccgaacaggccgattcctgataccatatctccctcaaagcccttctgaggctccctgttgccgtgcaggcgcatcacagggcagaagcaggcatactggaaccagcggatgaacagctttctgaacgtgggatcctctccgctcgcgccatggaagcctccgatatctgtggtccaccagggaattcccgccatggccatggaaagtcctgcccgcatctgtctgcggaagcattcaaaggtactgtcaatatccccggaccatacaagagagccgtatttggcgcttcccgcccaggccgaacgcaccaggtttatgggattttcatccccttccgccttcatgccgtcataaaagccctttgtatagagtttgggatatatattacccacctccatgacactgcccagctgatatctgtaattgctgaaatcataggtggtatattccggctccgccacatccagccagtaaaggcgcgctcccttatcccaataattttccttgatcttgctccatacatagctcctggcatcagggttggtggcatcaaagaaaagctcctgtccgaaacaggtcatggcgatacgcacgccgctttccgttctgaccagataacccttttccatcatttcccggaagttttccgaccggtaatccacggtaggccataccgaaaccatcacacggattcccatgtccgccagttccttacacatacccggaacatccggccagtatttttcatcgaatttatattccccctgctgtgtccagtggaaaaagtccaccacaatgacatccagcggaagtcccagttccttatatttatgagctaccgcaaggagctgctcctgtgtctggtaacggagcttgcactgccagaagccaaggccatattcaggcatcatgggagctttgccaaccagccccatataagtttcttcgatttctgccggcgtatcacctgcaatcacaagataatcaagctccttcgtgcattccgcttcccattccgttccgttcacgccaaaggtaaccttgccaacagccgggttattccatagaaatccgtagcctatattcgatacataaaaaggaacgctcacctgggaatttctctgtgccagctccagcatacagcctttcatattcatatatttctgctgatactgacccataccgaaaattttctcttcatcatccgctatgaatctggcagccgcatggaaggaatcccctgccacggccttgaattcccgtccatatacattaagaggcatactgggacaatccttaaggcgcttccactgctccttcagcagcagcttcttgtcctgattataaaaagaaagaacgccgtccgcattcaccactgcagttattttcccgttagtaagggagccgaaggactcatttttaccgctgtacatattggcataaacgactgcggaagcatcctggtcatcataaacaactatctcgccttttccctccgccttttcttccaaagcccagttatttccggtaaaagaagcgttcatagaagcccttactcttaccgcatcattcccccacggctcaatctgaaccgtctcgttgtcatattgatagatcaggcagttatcttttttgaaaatcatatttttccccttcttttcttattatctcaaccttcgcccctgcccctgttccctccggcccgtactttcgagactgctgcccggttcggctgccccttcttccctcagccagctatgcagggtatcctgtaaggggcgtataaactcgccggtccttaggccgcgtactttgcggccttagtaccgctgcgtgtttatccgaacgataagtcaaaacgactaaagtcgttcccctgtaaggatccctgcatagccggctgagggaagaaggggcagccgaaccgggcagcagtctcaaaagtacgggccggagggaacaggggcagagacaaagtttaagttactgaaaaatgggtgcacatcctacaggatatgcacccggctgtcttacttgcccatggactgcagatatgcttcataagctccgttctgaatattcatcagatcctgtaagcccatgctgtccagctgcttcaggtaagcatcccattcttcatcgatgcctccgtctactacccagtgtgcaaactgtgcttccacatatttataaatatccgtgccaagcgttgttaactgtgtcagttcttcatccgtatattttaccatagggaatccgacaacattgtcatctgctatatatttgccgttgatggcatcctcagccagtttgatcccgtcaccctgatctgcaggaaggcttaccttgtcataaaattcaggattcatatatttcggtccgaagtcacgcatggaattggaccatgcggaagtatccagggagcttccatcggaaggaacgagcacatcataagttccgtcgccgttatcctgtacctgatccggtatggaaccatagaaggtctgcagagaagctaaatccgtatagaagtcatcagcccatgcaagaagcttttcaggattctggcagtttttggtgataagcagttctctgtctgaaatatcaaggaaattctgtgcattttccacatgatgctttccgtccggtcctgtaatcgcttccagaggaacgaactgacctacgttcaggcctgtttccgcatcagctgtccatgccgataccagacctacctgggaaccgccttccgcctgcagcttgcttcttctcatggcatcttcctgcgtgaagaactcaggatcgatgatgcccttctgatacatatcgctgaaccattttacagattccttataattctcttctaccggcatgaaaacaggttttccgtctacaaggctcatgtaattgttatctctgcttaccatggttccgaaagggaacaggtaattacgcaggcagccgctcaaagtatataaacctgcattgccggtaattccgaattcgttgttgggatcgccgtcaccgtccgcatcctctgttacgaatgcttccagaacattttccagctcttcataggttgtgggaacctcaaggttcaggttatccagccattccttgttgatataaagaatattgccgcatacctccggtcttaaaggaagctttttcacaaggctgtaaatttctccgttacgatcctttgcccttgccagcaactccggctctttttcaaaaacagccttcagattcggcatattctggtcaatcagatccgtaagctccaggaaataatccttattctgggaaatgtcggtatccttcagacagatagaaccgaaaaatgcatcaggaaggtctccggatgccagcagaagggatttctgctcctgccagtcattgtcataatatacctgccattcgattttgattccgtgcttttcttccagctctttcataaagccgctttccaggaaatccacaggccatgcatccgtccagcgcacagtcgcgattttataagtagtgatatcttcagaggttccgttatctgctgcttccgccgtatctgacgcctgtgtccccgcggtattccctcccgattgcgcggtatctttattgctgccgccgcatcctgcaagcatggatgctgtcatcactgctgccagtccgatactaagtgcttttttccaatagctcattttcatctctccttttcttagaaataaatatttatgtacttttgctttccaagcaatgaataccttagctttcattatcccttcagagacccgagcataacgccctggttgaaatatttctgcacgaaaggatacatacacataataggtgcggaggataccacaattaccgcatatttaatcagatcagccatctgcttggcttccactgctgccgcgccggttgtcatggcgctgatcttctggttgctgataagtatattcctcaataccagctgcagaggctgcagctccggactgcgcagataaatcaatgcgttgaaataggagttccactgtcctaccgccgtccacagagctatgactgcaataaccgccttggaaagaggaagaactattttgaagaaaaagttcaggtttccgcagccgtctatctgcgcggcctcccataaatcatcagggatactgttgttaaagaaggttctggcaactataatataataggtaattacggaaaacggcactaccataacccagaaattatcgagcaggttgaaatccttaataaccagataggtaggaatcaggccgcccgtgaaaaacatgggaatcagatagtaaatggtaaacagctttttcccgcacaaatcctttcgggaaagagcataagcggcaggtatattaacaaccagggaaagaaccgttcccagagccgtatacaaaatggtgtttttataccctacccaaagctgggaatattcacccagtttcaaataacccttgaaattaattcctttgggcagaaacacgatatttcccgccgatacatccgaagggttgcttatggatgcaattataataaaatacatcggatatagaacaataatgatgattatgatagccagaagataaaggaagaaatcaaataccttgtcgtttttagactttttaacccttatcccggcagttccgtttttattggacatttctgtttcccccttataccagtgaagtatcactcatcttctttgagatatagttcacagaaagaagcaataccagatttattatattgttaaacaggccgattgcggctgacaggctgtactggctgcttaccagacccatcttatatacataggttgagatgatttcactcgcactgctgttaagggtattctgaagcagataaaccttttcaaagcctacgctcatgatgctgcctgtacggaggataaacatgatggttgcggtaggaagcagcatgggaatatcgatattcaccagcttctgccatttgctggcgccgtccatggtagccgcctcataaagggaaggatccactgccgacagggccgctatgtaaaggatactgtcccagcccacatgctgccaggcttcggtccatacatagatactggaaaaagcggagggctggcccatcaggttaggaagggtaattcccacaaagctcagaagctttgcaataattccctggctgggtgaaaggaacaggatgatcataccgcacataaccactgtggaaataaagtggggaagataagtggatacctgaaaaaacttcttgaatccctttcttgccatctgattgcacataagcgccagtgcaatcgggagcgggaaggttaccacaatgctgtataagctgattaccagcgtatttttgatggttatccagaactgataggaattaaaatactgtctgaaatacttcagtccggcccagctgctccccatgattccctgcgatggtgtaaaatctttgaaagctatggttacgccatacatcggaatataggtaaaaaggaacataattaccagcgagggaagcatcagcaaatacagggaaccgcttcttttcaacctctttccgatactgactggctttgcagtgcttactgctgttttctgtcgtgccactcttttcatcactcccaacttctttttttattacttgtgctactttttttggattatgccatactttttcgtcaattttaatttttgtacaaatatttattttgctttctgtaaatattgtatatttttatgtaatattaatctataaattctaagctgagcacataacaaaaatacggggtcttctttatatgagtttcgtaaagaaggccataattttgttatttacagcttaaaaatgataatttatataaaagtcaacaggaggggataaacataaatctgtcattattccggcctgataacaaaaatgtgataactgcccgaaaaaaaagcagatatatgaatcagatactccgaatggaaaaggggccctgtattacatatatctgctattattgctttttatacggctttcttaaccctgcttttttgttaccctgtttctgtactcattgggagtacagccggtataatcccggaaggttttgctgaaataggaaaagttgctgtagcctacctccagcgccaccttgctcactgaaaaggtggaatacttcagatattcctgcgctttctgcatcctgcaggaggctacatagcttgggatggaaataccggtaacattcataaatatcttggaaacataatcttctgacaaatatacggatccggccagggttttccgggacaaatcctccttcagatgatcatttatgtagtgcttgatctgttctaccaccgactcctgccggttatcctgatgctgaaagcccgcaagcttttcaaaaatatatcggataaaaatttccatgtccggaagggttgccaccgcactctcataatgctcatcaaattctcttccgtcaaaaatcctggtaatcagcacatcctgtttattcagatacctgtatatcatctgcatcatttccctccggaattgctccagtgtggaaattgtcacctgattgctgttccagagctcctccagaaaatgaaggattttctcctgggtatcggctatcatatccgaagccgacatttccttttcccatatctcccacggcggggatacataggcaatatccttcttatcccattcctcttcaaaaagcatcccgttattaccgggtaccgcttcctgctccatctgttccagattcctccggctttttcccagctcttccacggaagaactcactcccatataaaagcatacgcgcatatgcagcgctttttccagacattccttcagctggcaggaatccattttcctttgttcctggcttcctttttcttccgccacaagaacccattcataatcactctcacggaggacagccatcagcttctgatgcctgtcttccatgaattctgcggcaacattctgaataataaaatgatacaaaacaagattcttctttttcttagtatcagaatcgggaaaaatccgtatgatttccagaaaatatttcccctccggactgcatatcccctctttataacctttctcaaggagagaccggctgtagttttcctgcagaagatacctctcccaaaaggctgattttttgtcctccccttctccctgttcttcccgttttttctgcagaatctccactatgcttcccagcgcctcctctagttctctgttggaaaccggttttaacatatattcccttgatttgaggttgattgctttctgggcataggcaaaataggcatagctgcttaaaaatatacattccacgggaatctctttatttctgacccattccagcagctccagcccgctcccctgaggcatttcaatatcagaaagaagaatatccaccctggcctcttccaggatttccttagcctgtctgatattataggctgtcagtacgatacctattcccagctgcttccagttaaccccttccaccagcttttccaccaccagcttatcatcatctacaattaaaatactgatgtccattcttctcccccctttttccttttgatacaagaatactatacgagggaaaataattcaagaaacacagtattcacaaaatcgtaagttattttatttcatttgacattatttgttaatagtgttaaaatattaacaaacggggcgtcatataataaaatgacattgaggggagcatgacatacccggttacgacactattacatattttaaggaggtatttgcaatgggacgttttactttaccgcgtgatttgtatcatggaaaaggatctctggctgaactgaagaatcttaaaggaaaaaaagccattattgtagttggcggcggttccatgaagagaggcggatttctgggacaggctgaagagtatctgaaggaagccggcatggaagttaagctttttgaaggtgtggaagctgatccttctgtagaaacagttatgcgcggagccaaaatgatgcaggaattcgaacccgactggattgttgccatgggcggaggctctcctatcgatgcagccaaaaccatgtgggcattttatgaatatcctgatgtaacttttgaagatctgatcactccgttttccttcccggaactgcgtcagaaagctcatttctgtgcgattccttctacatccggaacggcaacggaagttaccgcatttgcagttatcactgattaccagaagggtgtcaaatatcctctggcagacttcaacattactcctgatgtggcaatcgttgatcctgccctggcggagacaatgcctcccaagctggtagcgcatacaggcatggatgccatgacccatgcaattgaggcttatgtttccaccttacattgcaactatacggatcccctggcgcttcatgcgattaaaatgattcatgattaccttaagaaatcctatgacggcgatatggacgccagggctcagatgcatgatgcacagtgcctggcaggtatggcattctccaacgccctgttgggaattgtccattccatggcccacaagacaggcgctgccttctccggaggacatattatccacggtgcagccaatgccatgtatcttcccaaggttattaaatttaatgccaaaaatcaagaagctgcagaacgttatgcggacattgccagatttatcagccttcccggcaataccacggacgagctgattgaatctttaattgaagaactgcggaatatgaacaggatgctgaatattcctctcggaattaagaattatggtgaaggcggccttatagccgacacctccatcattgatgagaaggaattcctggataagcttcccactgttgcagagcttgcgatcggtgatgcctgtacaggaagcaatccccgtattcccacacaggaggaaatggaaaagctcctgaaggcatgctactatgatgcagaaatagatttctaagagtttcccctatacgaaagagccggtgcccattttggacaacggctcttttcatagaaaaagaaattcttaatctttctaaagtatttctaaagtcccttgttatttcccaaatctgcgcatagaatgttggaaaaggaggtattgataatatggatttatttgataagattggaaatatcgctaagaatatcggtgacagaacaaatgatgctattgagatcacaaagctgaatgctaaaatcgctacagaaaaaagtgcggtggctgaggatctgaaaaaaatcggagagttttactataaaaaattcgctgatgaggaacccattgatacggaaatccaggaattctgtgacaacgcagccagccattatgaggctatcgatcaggcgcaggcggaaatagaacggattaaaaaagaaaacggcgtaaacaaagagtcttccggacaggaagagccgaaaaaagacgacgaggcaaaggaagaggcagaagcctgcgaaaaagagccggaaccggaatctatggtcgtatgccccaattgtcaggctgtaaatccggaggggctgaagttctgtacgcaatgcggttcttcccttgaaccggaaaaggcagtaaaagaagaggataaaaaggaaacggcaaaatgtcctgtatgcggggaaccgctgaacaaggactcaaaattctgcgggcattgcggggcaaccatcactccgcaataaatattatctatgaaataaaatataaaaacgctgcggatccgattagaatctgcagcgtttttatattttaagtaagagaaaatttcagctactctcctctttccttcaagcacttttttaagtccatataccattttttcccgataggaagctgtattccgtttgataataccgccgtataccggcatatctcacggatataagccttgtttaccagataactcttatggatccggatgaatgggaaattttcaagttctgttaaagtcatacgacaggaaacaataccattctgtgttacaatctcacagatcttattattcgctttcataaataatatttcatctgtcagcagataatgaatacttccgctcagattacggatcgtcagcttactggaatctgccggataaagcatatgatctgtctggttacaattttcaaatatcttggactgtgcattttcatacggcatcttcttggcatggttggcattggcatgaaggagccgtaaagcattaccattttgtctccatacaaaggtgaaatggattctggaagaaagccccaaagctgtggccgtaaaacgtccatacgttatccatatatggctttcatgagacaatagagcgtactcttcttctgtaatatctacaggctgttcctggatctcttcttttacactttccaaaaaggcaggaattcccttcatgtagagtggttcaaaatccccgatccatacgaaattgtcatccagcaattcagcgaacggtctgacctgtttgcgtataaacatatgtatggcttcacgggtcttttccaaaatttcctgttttgtataattactgtatctcattttttctctctgtcttcttttatattattaccgtattatttttgaaaatattgaatttattataactgatatattcgtctcatgcaacattctattctgtttacgaactatattttccgtttacgaattttattgattttaaaattaccaggctgtaaaataaaattattataaatccattattcttatagaacaaatcatatatagattctcgttctaaatgtggtaagggtatataaaggagcagccattcatgagcataaatcggaaaaagagttgtgaagaaggtatggtacaaaagattgacgatactaatgaacttgaggtgttaaaaatggaaaattcacgtctccaaaaattaacacagcaggattctttgacaggattattgaatcgcagggcaattgaatcagaagtaaacaaattgctcacagataaaatttccggagtatttcttatgatggatatagacgaatttaagtacattaatgacaaatatggccatcttacaggagacaggacattagtcgaactgtcaagaattatggagttgtgtttcttcagaaaagatctgattgggcgtattggcggtgatgaatatgcagtatttatgccaggtgaatataaggaagacatgataaagaataaagtgggcagtctcaattcccgatttaagcaggcaggacaacaactgggcataaatgggcggctttgtgttacggtcggcgcagagttttcacgcgatactgacagttttcagaccttgtatgaaaaagcagacattgccatgcgaattggaaaaaaggactggaataaggcccttaatttttataagcccacaatgaaaacaagtgatgccggcatggaaacaagacagaatcattcagtcgctgcaagtgatattaaagctatcagtcttcagctccgggaatctaatcctgcaaaaggagcttattgtcagaattatgatgcatttatatccgtataccgttttttagtacggggtttatcacgaaccggatcaagtgttcacatgattcttgtatccatgactgatcaggacggcgtttttatttctcttgataacagggcttttctgatggaaaaattaagagaaagcctgtgcagttcccttcgttccagcgatatttatacccggtacagcagctgtcagtttctggccatgctgcccggtgcagctttggaaaatatgaacatcatcacaacccgtatccagaattctttccgggtacgggttcctgacagggaagatcttcttctgtcttttagtttttatccgctgcagccgttgcagaaagacaaacgttcaacgaataaagaaacataattatttttcataattccgcacagcttcccatctcgcgtcttcttttttcttcgcgttccacagatcgatatccagcatggtttcatagcccagctccttcacttccttgcacatttgttcatacaaacggttgaattccgcctcatctgctgcaaataccatattccaggaatattcctgaataaccttccggcactgccgccggatagcagccatctcagaattttcctggggagccatatagccggtacccggagaaacaaggatcttattgtttttctgcagatattccatggttgtttctgcccccattttttctctccaatcgatttccagcggggaaatattcatgttccttaccgaatcccatagaagatacgcatacggataccctttttcatccagttcgcaggaagcaacggtactgtaattcaatgcggatattccttccgaccaggtacctttcccccattcctccggaacttccacatcctcgcccagcaaggcttttttaccaaaatccgttaaataagggccgtcttccccatattcccagcataagccttcgggtcctgccattccacccgaggtctgcgccctgttattccgtattccttccggtgaatacagccagtcaacgaatgccgccagtctttccggatcctccgccttggagccgatggacatcactaccttctgatttcctacagggctgcagccgtaggaataaataaccatatccccgatatccgccatcataaatccctttccttcttttgtcctctcctgtgtattgtatgcaggctgggctacccagggccatgtacaaaaaagcagctggccttctttatatttggtttcaaaactttcaaacgtctgcgtacttgattccggatccaccagccccatctggtttgcatcaaagtaccatttcaatactcttacatatagggaatccggatctataatactctgataatcactgctgtccgctttcacaagcacaaaaccgtattcatcatagccataaaaacagcagggctgtttcaccgcattcatcagattggaatcccagtctttaaaaaaggaaaatgcataggttttctccccgttatcggcagccggttccaattcctgcatttgtttcagaacagggagcagatcctccagcgtatcgatttggggatatcccagttctttatacagatcccagcggatatagggtccatatacgggatccgggttttccatggaaacctgcggggaattcatggacaattcggaaggaatggcataaatacccggctggctgacattgttgttcagatcatatatggcatctttaaagcgcataatctgcctgtttttcaaataaggttccatatcaattatcagcccggctgtaaccatatcctgcaatataccgttttccgccgaacatattaccaaatctcccagattgcctgccgccgaacggatctcgaacagggtatcccctccgccggaaacattaggcgcaatgatattaagttccatattgaatttatccttcacaatttcagcaaaccagcctgattgtattccctggaaattggcaagagaatcaaacacatccactacgatgaattcctcatacagatttgcttctttctcttttgcacatcccgttaccgcaaaaaccagagtacacaaagccaaaacagacagggttttcttaattctttttttcatatcattgtctccttaaatccgggtttatcacacagcacgcagagtcgtacatacattgacaatctttcaatgctcttttatacttaaaatacaggttatttttatatttccaacatagaaaggcagccaaaactataaagcggggtagtaaattggaaaccgtactgattgcagacgatgaaataaatatccgtgaaggtctgaaaaatattattgactggaacgaacttggctttgaggtatgcgcggaagccgccaatggagaggaagcgctctgcctgatcctggataaaaagccgagtctggttctcctggatatccgaatgcccaaaatatatgggactgatttaatacgaatggcccgggaaaggggcttccagggcagatttatcatattgagcggttattccgattttacatatgcccagacagccatacagtacggcgttgatttctatatcaccaaacccattgatgaggatgagcttcagctggctatctgcaaaataaagaaagaactggatgaagaacatgccgtttccgaaaatatggaattgctgaaaacaaaagccaaggatgtcatccttcacgagatcgttaccggaaactgtcagactcttgaagaaggccttttatccccgcgggaaatcgaggagatgaatctgtatgcagagtgctaccaggtagtgatttacgaaaaattcagtgaaaatccgaaggatgccagctacagcttcgcagatcttctcaaaataacaaataagggaaaccatacctttgaacactttaatgaggacagcaatgaagtcattctcctgaaaggcagctttgcgctgaacaaatttaacggttttctggaacgctatgaaaaaaatcttccgcagaaaggcagtcctctggattccctttttcttgcctatggccgtccggtttccaatctggatgagatttatctgtcctatgaggaggcttccactctccggaaaagacgttttttctgcatgcaggggcagcataccctgggctatggggagctccccaaatttcatgagatttctctggaaatcaataatgatacgcttgaggaatacagcaatctcctgaccgattatctgcttgctttccagcgcaataaggtagcggaaaccttattcagcctggaagaatttctgtataatgtaaaaaatgatatttcttccgtaaagctgttcctgaaggatttattcctgcgtataaaggaaaaggtaaatcatacgttccattcggcggaaattccttttcccacaaactcggagattatccgccgcatcgatcaaagccgttatctgtatgaaatcattctcttcatttccgctcagacagaaatgattatgaatgccaccggacgtccgtccagagacaccatactggatgatatcatttattacattgacaacaacttccggaataatatcaagctggaggggattgcccccctcttcggctacagcagtacctatctgggaaaaatctttaataagacctttggagaaagcttcaactgttatgtggatcacagaaagatcgaatactccaaggagctattaaaggaaaaccgcctgaaggtatatgaaatagccgaacaggtaggctataataatgtggactactttcataaaaaatttaaaaagtatacgggaatgagccctgcggaataccgcaaaagcatttttacccccccccccgcgataattcgtctgaaaattattgatacacgatcttatcgaaagaaaaaccggcacaattttatcttcccttcggtttctattttcaatgtgcagggttcttccggcacccggaaacctgaggggaaagacatgctgatatcttcaaaggctcttccttccctgatttgtattgtcaggcttttgggttctattccctgcgcacagaaggatattctcatgcttccttcttccagtgcataaatgtttaataccattccgcagggatttctgtcaaacaggaaatcatgatataagagctctcctgttgccttctgtccggaagtatgctccggcatgtcaggattgtctcctgcctttccgggaattacacaggtgaagccgtccgtccctttatgtataaagcaattgtcataatcgtcatatctgtccgctgccgtcacttcccatggacttctcacaccggtcttttttccctccagacagataaccgccttctgacgtatatcccgggatgatgcacctgccaggaaggtatactctccatcctccagcagcatgccttcagaaatcacatcataaatcctcagttcctcacaatttacaatgaattccacctctttggtctcaccgggattcagattcaccctcgtgaaccctttcagacggctgattggctgtctcacacgggaagtttccttgcggacataaagctgaaccacttcatccgccggatattttccggtattggcaacagtaaggcgcgcgatcaccttatcctcctttttttccagattcagctttccataggtgaattcggaataggataatccataaccaaaaggatacaatacttctctgtcaaagtactgataggttctctttccctttatgatatcataatcattcatatccggcagatcttcgtcggagatataccaggtcatattaagccggcccgcaggggaaacttttccgctcaatatactggcaacaccggttcccagctcctgactgccggaagcactccatataatacccggcatttcttcctgaaggcggtttatggaatagggataattggacaacagaacgactattgtttcgggattagcttttcttacagcatccgccagattttgctggaatggaggaagggcaagcgtactccgatcgatctcttccttgctgtttatcaccggattacagcccaataccagcacagcacgctgtgcattttcggcagcatgtaccgcttccttgattccgtcagcttccacttctatggtaaatacggccggttccccttcttttgtaccgcatacaaggaatccgctgctatctgcagtcactgtcattccattccagctgtcaagataatatgtctcccggggcatatccttttccttcccaaccggcctgaaattccaggattccctgatgaaccaggagaaggcttcctccctgccggccttcatatagggatcttcttcttccagagtgacaaattttccattgctgcaggcaaccagtgttgtactgccgcagccccagtccgtaaaggtgaaacattccgccttatccttttccgtcagataaagatgaccggattcatccatacccacatactttccgccgctgcacagataaatccgtgacaggccgctgacggagacaatgctcgtatccggataagccttttttatcccgtcaagcacagtcactgtatagggagggattccgcagtaccagtctttgtaccatacgtccgcaagagggcctataatcgccagggattcggttttttcgggaaggaacggaaggatatttttttcattttttaatagaaccacggattcttccgccattttcacacaaatatccctgtgttcctgattattgacatactcctctcccattcccgtataagggcattctccgtccccgtcaaagaatccgagtcggatacgagtgcggaaggaattacgtatggaccggtcgatgtcttcctctgttatcatccctttttccagggctttacgtgcggcctccataaccactgatttatcatccgtaaaacagtccactccggccttcaggccatatgccactgtctcctcatgggttttaaagtatttatggtcataaacagtctgctgcatgtccccgccgtcgcagacaacatgaccgggcagcccccaggcctcttttaatatggtacggacctcctcattcacaatcgcaggaattccgttaatttcattgtaagaggtcattaccgcttccgctcccccttccactatggctttccggaagggctccaggtaatattcatatttatttctgcgatccaatgaagaagagatggaaatcctgtccttttccacattatttgcataaaaatgcttcagggttgccccgcacctgatatagaagggatcgtctcctttcattccctgtatataggaagaagccatctcacctgtcaggtacggatcttctccataggcttcttcggttcttccccatctgggatcccgctccatatcaacggttggggcccatctgcaaagccctcccgaaccattgcgggtaaataaggctctggcctcttctcccacgcagcgtccgcattccctgataagctctctgtcgaagctggcactcattccgatgggctgcgtaaaggatgttgtgggttccggttctcctttattaaaagcctgatcatgtctggcttctattccatgggctgcctctcctcccatataggaggccctgattcccagtctgcttatatccgggcagccggtggtcaggcaggcaattttttcttctgtcgtcatttctccaatcagataatcgagccgttcctctacaggaagccgattattccataaaggactttttaagtagttttccatgttcttaatagcttctcctttccacggtggttcctttcaaagcctgaaaagggattgccgcatcggacaatcccttgattaagtttttgagtccagcttcagaacctgttattttacagcatcttctgccgctgccttcagtttcacttcattttcctggaattcgatgcacttatcatagccatattcatttgctttggcaatcatttcatccactattttatcaaattcttcatcggaggtagcataaattgctttccaggaatttgttttgatacagtctgcaacctgattccagagtacaagaagctcatcagatttggttcctgcggaataggtggttccgggggcaagcttgtagggtctctgtcccatgtattcatcaggtgttctggctttggtatattctctccagtcagcctcgatttccgagttgggttcactgatgaagctgtcccatttcttgtaattataggtatctccgttggaatccagatttaacgtatcaagagcccaggtctcattattcatcttgaagtctccgtcttcaaaggttcctgaataaccgtctgtcatttctgtcttcatatcaagctttgcagctcttcctaaatccgtgaaacaggtttttccgttttcatcataataccagcatacatccttggggccatattccgatgtcatacggccttccggtgtggaaagccagttcagtatcgccatgcaaagttccggatattcggtttttgcgccaatagaccagattctgttgccgccgtatacattcagcccgtaagcgatgggcgttgcttcctccggaggacagggatacatggcttttccttctgccgcatgactgtcagagttatacatggctgctccgaggaaattaaatacattcaggaatgcggtgccattctgatagtcttccaccataccgtcatatttctgggtctgtgaatccggatccagaagtcccctctgataaagatcattatagaatttcagacaggtaaggtaaggaccgtccttttccagacagggataatatttctgttcctcggagtcataaagaccgaaaccaaattcatcgtatccataatatgcggtagctgtggattttacaaacattaccatatcaccatcccagtcattaaacagggatacaccataggttgtttttccattgtcatctttagggcagatttccttcatctgcgccaggacctccaccatgtcatccagattctttatttccggatagcccagctctttataaagatcccatctcacatcccaggtatacatgatatcgcctctggcgctgggatccaccgccacatcaaaaccatatccataggtagtaccgccggaaaggtttgcatttttttccagggcataaggcatatgttctttaatatacggaccgtaatcggtcagaatatcatcctcattccagtcgaacagcatacccttctgaaccgcctgctgatattcatcggaatcgtttccccagataacgatatctcccaggttgccggattccatacgggtttcatataccccgtccgggtcaggaatgatattcagttttacattgaatttttccagcataacctgaccgaaccatccgatttgttctccggaatagttggcaagctgatcaaatacatccagagtgactgtttcctcaggaatgatttcttccagaagttcgtcataggaatccccctcttcaccggcctgggtatcccctccggctgtttctccatctgtttcagcatttgcctggacagtgctgtctgccacaggctccgaagctgttttacttgaatttccgcatgtggccaatgacagggtcattatggccgccataagcagtgcagtgactttttttgctttcattctctttctcctcctttttgattgtgttacataaccgtaaaaacggataaacaccaacaataaatacagataaaatttccggtcagactcagccttttacggctcccagcatgatacctttttcaaaatatctctgcatgaacggatacaccaccagaatagggatgaccgttaccatggaaattgtatatttaataacctttgcactaagcgctgatttaagaaccgtatcactgatctgtccgccggattccatcaatgcgctcagattggaagctgtattcagataaatatacagtctgtgctgcagggtatacagattaggggccgactgcatcagtatcagggaatccgtaaatgaattccagtgtcctacggcgccgaaaatggctatggttgccagaataggtttactcagcggccatatgatcttacggaaaatcatcatatgggtagctccgtcaatctgtgcactctcctccagctccgcgggaatggactctatgtaggtctttaccaggataatattataaggagctacaattcccggaataatataagcccagaaggtattggtcaatcccagcatctgcatgttcaggaaccagggaatcaggcccgcattgaaatacatggtgataataaggaagcggtaccagaattttctgccccacatctcctgctttgttaccaggtaacccacaaatgcggaggccgccaccatgaatgccgttccgataatggttcttcccagtgaaacaagaaaggcattggaaagatcacttacattcagcagggatttgtaattatcgagatgaagccctctggggataaaattgattacccctttcacgaccaaatcgttgtcgctgattgtatttataaacagataataaaatggaaaaatacatgccacagtaaacagggtaaaaaccaaatagtttatcatattgaaaaggatgtctcccggtctggccctgtattttttcctgtgctttttctcataaattttttctgccttcaggtctgctttttcctgtgctgattttgccatgcttaacctcctatacaatactttcaccgcggatcaacttcgatacaccgttggcggcgaacagcagcgtcacgcttactatggatttaaccataccgattacggtagacaatggtatggcgccttttccgatacccagcttataaacatacagatcaagaaccataatagcgttctggttggttgcattttcgaataccagatactgatccattccgttgctgaggatattggcaattgacataagcagcaatacacagaaggtaggtatcagccccggtaccgttatatgccacattctctggaatctgcccgcgccgtctactgttgcggcttcatacagctgctgatcgattcctgaaatcgccgctatataaataatggcactccagccgattcccttccaaaggccccagcccagcatcttgatccatacatgatccccgctcatcagcatattgacaccctgatcccaaattcccagattcaccataatactgctgacaaatccgtctgttgagaaaatacagaacgctatggcatatacgagaacccagcttataaaattaggaactgttgttagagtctgtacaaatcttcggaatcttatattttttatttccgacaggaatatggcaaaggccatgggaagccagcttgttgcgattccaagtccgctcatggcaagcgtatttttcaatacacgcacaatatcccttaccgtggcgggatttttaaataactcggtaaaccacttgaagcctacaaagttttccatgcttatggaatcccccaccttataatcaaaaaatgcataacgccatccccataagggcagataggcaaagacggctaccaatgcaagaaaaggcatcagcataagaaaaagcctgtattttgtgggcatttcaaatctggatttttttgaaagctttggaaataaaaccagctgtatgactgaaatcaacagaatgagcagcgttattattaatatcagaagaagcccggaaggaaaaacaggctgtatcttatcaggtttcgcagtctgcgatatctgtagataagcaatataaattcctccgatacctgccagttctgcagcgcatcctatcgtaccgatgatatttcctgttttcttgaattttaaattaccaagggacatgcatccgcttacacaaaaagcaacgatcccaagacacatggccatggatgacacgaataacagctgcatggagctttcctccacccatcctttcctgaaggcccggccgaattccgccgttaaggatgaataggaaatacctgctgaaaataaagacatatttttatttatcatgccgcttattcttgccggattcagatttggtataaacagaaataccacagataaaagaatggcaatccgaatgggataataaagcttatccgtaataatttcctttcgtgactttgtactgctcattttattcctccctttcctgaacaaaattttcgtatttttagtaaaaaaaatacaccacaggatttttcaatccttatgatgtattaattataatttagttaaaattagaaaaatacggtaaaattctgcctaaaagtacattcactttttgaattcttccggtttaaccttcatttgctgttacaaccgctgtctctttcatacggttaatagggataaaaagactgacacgggttccttcctctatgttggaagaaatcttaacaccatatttctgcccataggtaagcttaatccgctgattgatattatacagcccgatactcttatttctgcttatatccttttcttcaatcgtgctttgcagaaatgcaagcgcttcttccgtcattccatttccattatccgatacttcaatgcaaagcagttcttcctctcccagctgcttcctcaccaatatatggattaacccttccttttccttttcctccagcccatgcagtatggcattttcaactacgggctgaagcaacaggggcaggatgagaagctttccgggatcaatatcctccattacttctatctcactgtcgaatttatctgtaaaacgaagcttctgaatatccagatagacttttatgtgttccagctccttactcagcgtagtaaaggaggtacccgtattttccagaacataacgcatggatttacccagaagcttgattgccctggctacttccctgtcatttgccttaaaagctttcatacggatcgtttccagagtattataaagaaaatgaggattaatctggctggcaagcattttaaattccatcacctgctgttcattcagaagctccgctttattgatctgggcttcatacatatccgcatccttctttttaatattctgaatcatgatttccaaatcggagaaggcctccgatatttcatcctctccctggataaagcttcgtatatcataatcctcattgctggcctgatgcatggcctttcttaagataagaacacgggatgtaaaatactccgtaaaatagtgaataataatacccggtatcagaatagccaccgccaggatcaggacacagattgtcaaaatccgtttaatgcttacatagccctgatcattcatggtacatatatagagacgggaatctgactgatacaggttcagcgtggaaacatccacaaaataggtaacaccgtttatcttttttgtccctgtatattggtagtaattttcatcataatcaatggataccttttgtttgattccatattggcttctgtcagaattaaaaaacacctctccttcatttactgataccatggcagcatattcctggctgttgatccttgtccttaaataattgtcactgatcttgataaccagtaccgcattatattccgcatcggtcagcggaattctgcgcaccaggctcaaattccagtattcgttcccatatttatcggtagtagtcataggtatccagaatacactggattggctgattgctttctgataccaatctgacttctgtatatcctcatcggttttatagaactgtttataatccgtaaaagtgggattatcggtatatatctctatcccttcgatttccgcatgattctgcgcattattgtcaaccactgtcagattgccggccttttggatcaggttggtcctctgctcatagtccgtagataatatttcctttatgttttcatcaaaaataaggttctcggagatattatagacctgagtggttatttcaaacagaacatttttaacacggagattatctgattccaggagatccctgtgatagtttgcaagcagagtgtaggtattcataaggagaaaaataccgataatcatgataggaagaaataaagcagcaaaatatatggtatatagctgctgtcttatatttgtcagctttctaaaatgaaactttaactttttcataatcgttccgccctgtatttttcatccgtatataaataatttaatataaaaaaatccgtacaaaaagacgttattctttctgtacggatctacgttccctgggggaatcgaaccctcaactgccccttaggagatggacccagtgcatatattccctatcaacagggataaagaaaatgcagttatatcaaggcttttctccatgttctctataaaccttgtacaagcaaaatcaagcaaaaacaaaggattttagccccctattgtttgcactctgtttgcaaaggcgcgaaatttggcgttagccaaaagttcaattcccgtcgagacttaattatattcatggtatcgtggacatagtttaccatacatagaggttcattacaagaggtattgagccagtgaaagtgcctgttttatctttctcaggaaaggtaaagcaggcactttttttcatatctaaacttagaaagaaatgaggtgaaatcatgaatacacagattattgccatagccaaccaaaaaggtggtgtcggcaaaacaaccacttgtgccaatcttggaattggtctggcgcagtccgggaagaaagtccttctgattgacggagacccacagggaagcctgaccatcagcttgggcaatcctcagcctgataagctgccctttacactgtcagacgctatgggccgtattttgatggatgaaccaattcgtcccggcgagggtatcctgcaccaccctgagggcgtagacctgatgcctgcggacatccagctatctggtatggaggtatctctggtaaacgctatgagccgagaaaccattctgcgacaatatctggacacgctgaaggggcaatactcccatatccttattgattgccagccctccctgggtatgcttacggtcaatgcactggctgccgctaatagggttataatccccgtccaggcagagtatcttccagctaaaggtttggagcagcttttgcaaactatcaataaggttcgcagacaaatcaatcccaagctgcaaattgatgggattctgctgacgatggtagacagccgaaccaattttgccaaagaaatctccgctcttctgcgcgaaacctatggcagtaagatcaaggtgtttacatcagaaattcctcattctgtcagggctaaagaaatcagtgctgaaggaaaaagcatttatgcccatgatcctaatggcaaagtggctgagggctacaaaaatctgacgaaggaggtattgaaacttgaaaagcagcgcgaaaaaaatagagctggcctcagtagatgacctgttttctacagaagaaagtcggcaagacgagcaactggaaaaaattcaggaaattcccctatctgaactgcatccgttcaaggatcaccccttcaaggtcaaggatgatgatgcaatgatagaaaccgcagacagcatcaaaaagtatggtgtgttggttcctgcgattgccagaccactgcctgatggcggttatgagctggtagccggtcacagacgccgcagagccagcgaattggccggaaaagaaaccatgcctgtcattgtgcgcgacttggatgacgatgctgccacaattattatggttgacagcaatttgcagcgagaaaatctgctccccagtgaaagggcttttgcctacaaaatgaagctggaagccattaaacatcaaggagcaagaacagacctgacttctgttcaagttgaacagaagttgagcgccagagaccaggtggcaaaagaagccggtgaacgaagcggtatccaggtaatgcgatatgttcgtttgactgaactgattccagagcttttggatatggtggatgaaaagaaaatcgcatttaacccagcctatgaactctcttttttgaaaccggacgaacagcaaatgctggtggaaacaatggactatgagcaggctaccccttctctctctcaggctcagcgaatgaaaaagttcagccaggaagggaaattgtcagaagatgtgatgcttgccatcatgtcagaggaaaaaaagggtgatctggataaagtgaccttgagcagcgataccttgcgaaagtatttccccaaaagctatacaccggccaaaatgcaggaaaccattattaaactgctggaacaatggcagaaaaaacgccaacgagatcaggaacgatgaagggagagcctatgaaagatattgcagcaagggaactgaaaggccacaacattcttgcagtggagcgattttgggacagcactttctggatgattgagtttactgtcttgcgccctactgcttatggagaacctggtgacgaaatgaggctttttctcacagaggacgggtatcagtcagctctgcaaagccagcagcgtcgagaaatcaaaattaagagatatgcccatgttattgaggggcatatcctcgacttcaagcctaaaaaacaccgtcgttcataaccgatacaacgaaaggaaaggaatgaatatgtgtactgtaagagaaatccgagaagctattcaagaagattgccgctcacagcgtgatatggaatccaccgagattgatcgtgtttttcaaaccttaccattttctcaggaaagggatctgtttgataaaccaccaatgccaaaacgcccctaccgacgcaagaaaaaaagatacagacagaccctaaccgctgccacaattcttttatgaattgcggcttttttcatacctgagaaatgaaaggagtgaagtaaatggctgtttttcgtgtagaacgcactggcgattacacggttatgagcaattttcatctaaaagacaaacgactttctttgaaggcaaagggtctcttgtcgcagatgttatctctgcctgatgactgggattatacgctgtcaggactcagctatatcaatcgagaaagcaaagatgcaatccgctctgctgtcaatgagcttgaaacagccggatacattcggcgcagacagacaactgatgcttctggtaaattcgcagccaatgagtataccatttttgagcgtcccatcgagggagaaccgatgttggataagccgttgtcggaaaacccgataacggtaaacccgtcagcggtaaatccgttaccggaaaatccaacacaattaaatactaagaaatcaaatacccaaaaacaaaatactcatggatcaaataccgattccattcccttccgggaaacagcggcggtaataccgccggaacggaaaggaagggatgcgatgtctgtcacagagatagaaaattatcgggaattgattttggagaatatcgagtatgattgtctgaagcagcgttatcctctctacctggatgacctgaatgagatcgtagagctgttggtagaaacggtctgtgccaaacgaaagaccacccggatctctggtgcggactttcctcatgaaattgtacgctcccgctttttgaagctggacagctctcacatcgagtttgtcatggactgtctgcaaaagaacaccacccaggtacacaacatcaagcagtacctgcttgcagtgctgttcaacgctcctaccaccatgaataaccactacacttcactggtaaatcacgatatgcacgcaggcggctggtaatcagccgcttttgtattacaccaaaggaggcacagcatgaatcagattgaaattttcaatagtccagagttcggaagcattcgcactttggaacagaatggcaaagtattattttgcggtacagatgtggcaacagcgctgggatataccaatccacgcaaagccgtccgcgaccataccaggggtggaacgaaatgttccataggggtccagactgggaaaaaggcagatggaagccccgcggtacaaatggtcgaaatgctctttatccccgaaggtgatctatatcgtctgatcgcccatagtaaactgccgtcagcggaacggtttgaacaatgggtgtttgatgaagttctacctgtcattcgcaagcacggagcctatctcacaaaagagaagttgtgggagatagccacttctccggaagctctgataaagctctgctccgagctgcttgctgagcgggaagaaaatgcgtcgctacgagaggaaaatgccctgctggagagtaaggcagccttttatgatttgttcatcgacctcaatcacagtaccaacctccgcaccaccgccaaagagttgcttgtcccggagcgtcggtttgtccgtttccttctggaaaagcgttttgtgtaccgcaccgcatccggtaatgtactgccctatgcaaagccagccaatgaaggactgttttgtgtcaaagactactgcaatcacgggcatatcggctcctatacgctgataaccccgcaaggcaaactctactttgctcagctgagagacatgattttgatggttgtatgagagtgggaaaggaagtgagttttatgccagaaggcaaaacaatcggtcagctgatggaagaaatgcgccagaaagctggagcgcagaactatcacggccatgactacatggatctccagcgatttgctgagaacacccggcacatgattatttttgatgtgctgacgcatgactccccggtgggctggaaaggtgaacgaacccgcctgtttttgtcagataagggctatgaaaaagctctggacagtcaggcaaagggacagatcaagattctcagtcatgcaaaggtcagaaatggagatttgctctatgaccgttctgagcaaattcgttgagggcggttcgatgaagaaataccttctccggcggctggtggtcccgccttagaaataaatgcaccacccctgcacattttgtggaaagacctgctaacaaaagtcaagtagaaatttcaggttttgggagcagcgaaaaaggcaacacaaaatcaagccgctgagcaactcaaaatcgaaacggcggccagccagatggtatagcgcagggaaatcagtcgtgttccagggaatccaaataggctttcacagaagcgtagtagatacgcaagaacttgttggcggatgccatcatgtagacacggtatggcttgccctcagagcgtttcttgttcatgaactggtagaccggctcatccattggggcacattgcaggaggacgcccatcaccaggaaaagtgtcctgcgcagtgaggcagatcccctcttggaaatgctgcggctgcggacatctatttggccagattggtagggcggggcgtcaatgcctgcaaaggccaccagcgctttcttggaatgaaaacggcgcacatcgccaatttcagctatgagttgggggccgagtgtagggccaacaccaaacatttccatcactacaggatactccggcagagaagctgccagagactgcatctcctgcttgagagcagctaatgcggcggaagttgtctggagttgggaaatggcctgttctaccaaaagttttgccgtatttgttttcggcatgacaccgaagcgtccacaggcagaggcataaatatccaacgccttatcttggctgaaattgtagccgtgctttctgcaccacttctggtacttggcggtaaaggctttcttagacagaccacagacacactcgcaatgccaaaaagtggcgacaaagtccacccacttctcactgccatcggcgcggggcggactggtaaacaggcggtttgcgtctgggaaagcggtgtccagcagggagatcaggttgtttttcagcatggtctgtactttggaatactgctggtactgccggtagcaggtcttcagcatgagccgggtgtcctcttccggaacatatctcggaagtgtgagccagtggtcaaggccgtagttggccagcttcacggcatccttcttgtcggtcttgccccgtcttaaactgttgttcccgtagtcgtgcaccagcattgcattgactacggagacataaaaccccgcgccgtggagcagccaggccaccggcgcatggtaattgcccgtggattccatcaccacgcgggtctcaccgtccaggtttttgagcagccttgccagctcgctcagttcgctggcggtgtggcgcacttcaaagggtgaaaccactacctctccgaagggccgcatgactgcaatcatgctcttacctttggaaacatcgatgccaacgcagttcattcacattcctccaacacaaagaatctgcaaccggaaatccatcttttctcgctgccgattcaatctattgggtgacacgaactctccggcatccggtggctcaacctgctcaaatcgaacgctgcaacaagaggatggctaacagtctttccaacggacataaaagcccaaggaggcaagggtcagccagttgctcctcttattgtagcttaggcacgagatggaaagaaagccggactggctgcccggctttcctgtccaaatttattgtaataggaggcgatgaaaatgcaggaagaagtggaaaacaggactttaacgctggttgtcagcggaacaaagttcaccggcaggctgctcaaagccgccatcagcaagtacatggcccactgcaaggaaaagaagctgcaaaagcagagaagccgtgatgcccctgtgacaccccacggcaaacagaccgtcaagcagctcattggtcagaatcaggggatctccaatatcgagatcacagacccctccatcaaggaatttgagaagatcgcccggaaatatggtgtggactatgcggtgaagaaagaccgcagcagctccccgcccaaatacctgatctttttcaaaggccgtgacgccgatgcgctgaccgctgcatttaccgagtacaccagcaaaaaggtcaagaaggccgagaaaacggaacgcccgtctgtgctggcaaaactcagtcagttcaaagagatggtcaaaaatgccgtggtggaccgcaccaagcgaaaggagctggaacgatgaaaaagcagtttgacatcaaaaagctcgttttgctgaacctgccctatctcctgatggggctgtttgctactaacttcggggaggcatggcgactggctcagggggcaaatgcttcagagaaattcctttccctgtttgctgtcctgcctggggcgctgcaaagtttctggcccagcctgcacccgttggatctgctggtagggctgtgctgcggtgctggcctgcgtctggcggtgtacctcaaaagtaaaaacgccaagaagtaccgtcacggtatggagtatggctctgcccgttggggaacccgtgaggatattgcaccctacatcgacccggtgttccagaacaatgtgattctgaccaaaaccgagagcctgaccatgaacagccgccccaagggccccaagaccgccagaaacaaaaatgtgctggtgatcggcggctccggttccggtaagacccgcttctggctcaaaccgagtgcgcccgtaagggcggtataaatcctaccttgagcaagtagtaggtaaaagtatcaagcggcattgtgccgcaacctatcattccccgtcttaccccaaaagggaaactggagggcgaccatagcatgacggaggacacggggcgctgaagcctcagaagcgccggcgtgacggaatgaaaatccacgtatgaggatggaagctagactgcttgaatgacagcctgaaatcgggaccaagagcgtacccctgacgtagagaggttgtactcgtcagtgttcctgacagtcgcattgtttggctatgcggctgctgatactcggagcaggttcagccacgggaaagtggaaaaaggcgaacgtcacataccgacaacgtggaacgcttgtttataccgtactaaacggggattgcctaaagtgaaatgccgaaaggctatgaaaacgctgaaatgcggggttctgaatattcaccatggcaacagagttcccatagtagtctgcggacgggaaagccgtctacatggcaaaggggaacagtgaatcattttcaaaacagaaaggatggtgtgtgagacactatgagaaatccgattcatgtcttgaaaagccttgaagaaaaggcaagtgtaagtaacaacaaatatgaaagattatatcgcaacctatacaatccagagttctatctccttgcatatgcgaacattgcgaaatcgcaggggagcatgacacagggggtagacgggcagacgctggacaacatgagcctgccgagaattaaccggattattgaatccatacgcaacaggacatatcagccaaagcctgcaaaaagaaagtacattcctaaaaagaacgggaaacttcgcccgttgggaatcacttctactgatgataagttagtgcaggaagtggtcagaatgattcttgaagcaatctatgagccgacattcagcaacaattcacacggtttcagaccaaaaagaagctgtcacacggcacttacgcaagtgaagaaaaacttcacaggtgttacatggattgtcgagggagacattaaggcgtgctttgataacttcgaccatcatgtgttggttgaattactgcggaaaaggatttcagacgaggcttttatcggtctaatctggaagttcctgaaagccggatatatggaacaatggcagtacaactgcacctactccggtgttccgcagggcagcggtatcagtccgatatgtgcaaacatctacctcagcgaactggacaactatatgcaggaatacaaagaaaagtatgattgcgagccagaacgcagaaggacgaccagagaatacgagcgggcgtcccggagatacagaaaggcacgtaaagcgttaatgggcgcagaaaaatcaactcctgaactggtaaaagaatttaaggattccagaaggaagaagatgaatcagcactattacaatccgtttgaggaaggcttcaagaaaatccagtacaaccgttacgccgatgattttgtaattggcgttatcggctccaaaaaggacgcagaaaaaatcaaggaagatgtaaaaatctttctccaagaaaaactgcatttggaaatgtccgaggaaaagacgaaagtcacccattccagtaagccggtacgctatctggggtacgatttcaaagtaatccattccaagaacatgaagcgttgtaaaaacggcgacatgaaacgggtgtggtatggaaaagtattcctgtatatgccgaaagaaaaatggattaaaaaagcgatggaacggggagcgatacaggtgaaacgcaacaatgacacaggcaaagaaatgtggcgtcctatgccaaggaaagacctgatgaaccgcagcgatgcagagattgtgtctactttcaattccgaaattcgagggttatataacttctatcggatagcagaaaacgtaggcgcattgcacaagtattactacatggtgcggtacagcatgttaaaaactctggcaggaaagcacagaacgaatgtcagtgttattaagaagcggcacatggtaaacggagtactgagaatcccatacgatacaactaagggacgtaaatactgcgaattttaccatgatggattcagaaagcacagcgacggctatgacaatgtggcagacgttatgccgagttataggaaatatgacagcaggcacacgatagtaaaccgcataaaagccggagtatgcgagatttgcggggaacatgcagactatttatgtatgcaccacgtaagaacgctgaaatcgctgaaaggcagggatatatttgagcagaaaatgctgaaaatgagaagaaaatctctggctctctgccctgactgctttgaactcttacacgaaaccaaagaatcaaggtgattcatggaaagccggatacgctgagaggtgtacgtccggtttgggaggcggctccctgaaacctactgatgaaagtcagcaaggcgcagggtgcctacctcatatctgatgcagatgcacagttcttatgtggtcacagacccgaagggaaccattttggtggagtgcggaaaaatgctccaaaggggcgcacccaagctggggaaggacggaaagccaatgaaggataaacacggcaaggtcatttatgagccttaccgcatcaaggtcctcaataccatcaacttcaagaagtccatgcactataaccctttcgcctatatccatagcgaaaaggacatcttgaagctggtcacgacgctgatcgccaataccaaaggcgaaggcaaggccggagacgatttctgggtcaaggcagaaacgcttctctattgtgcgctcattggctatatccactatgaggctccggtggaggaacagaatttctccacccttattgagttcatcaacgctatggaagtccgggaggatgacgaggagttcaaaaatcgtgcgaccctaattgcagtgtaaaactcccgtagtagggtgacaccactgcaaacctgataagaggtgctaaggaggtgaaaagcggcacactcttgtaggtaattgatatgactggaggcggcatggaagccaaatattccatgtatccgacctcgactaatactcctgccggctgtctggtaacaggcagtcgcgaagcataggtgaaggcggggacactgctggtgacagcacaccccgggttccactgcatatggattcaacattccgcatttgctaaagcttcgttatgaaccctatcctgctctgctgtgcagagaggacggaataataaatctacctcacgtgatttcgttttgtcactatgggggatggcgttatggccgccatagaatacgtgtaaaacgtatcggggagacccaggtttacggagcagaggaagtcctaagtgcagtattaaggcagtcatattgataagggcgaactgcccgacgtttaggaatagccggggacggcccgcactgaaagggtaaggccagaaaggttatgaacgggtagtcagcggggccatagtagcgtagataccctgtcaagaaacagggggtagcgaagggccttagtcttgctttgaataataaaacaatatttccgattcgcctgattagacgcaagagactattcgttacggaaatgaggcgacaacctatgaagaaccaaagaaaagtaattgagtaccaataacatctattttgtggacatggaaaagcggtttgaagatttccagaataacagaattgacctacgggcactccacgtcatggtttatgacactgataacgtagcccttgcactgcgtcaattaagcaaaagtccgggaagaatggcactggggccggataaaacaaacatcaaaactctggaaccctactctattcaggaacttgcggagattgtgaaagaccgtctgacaaacaaaagaatggattatgtacggagaacgtacataccgaaaagcaatgggaagaagcggcctcttgggatttgctccatttgggataagctggttgaaaaatgtattcaactggtggtggaaccctattgtgaaacaaaatttgtagagagttcattcggattccggaaacaggtcagcactcacaatgcgctggcaaaggtgaaaagccaatgtcagacaatgccctatgtcctgtccgtggatatgaaagatttcttcggaaccatagacccggatatagcataccgggaactgtggcatatcgggataaaagaccagataatcctcaactatatctaccgtttcattaaaaagggatactatgaggattcctgtaaagtggagaatccgaaaggctctccacaaggttcgattttggggccgttaatcagtaatgtatatctacatcgatttgatgtatggctccgtgaccagggtgattgctggcatgacagaagcgttgcaaagtttcacaactatgcgaacaagcgacgcaacctcgcactcacaaatctaaaagttgggattcatgtgaggtatgctgatgacattctggtattgtgcaaggattatgaggacgctgtgaaattcaaatacagtgttacgaattacctgacacggaacatgaagctggaaatcaacgaggataagacaaaaatatatgaccttacccgggaaaagatgaagtatctgggatatgacttctatgcctataaaaagcagacgaagaacccacagcaaaaggggaagctgatggtgacaaatgagcttccaaaaagcaaagaggacgtgattgttaagaaatgcagggaactgctacatgacatcaggcgcaatccgtcatttgaaacaatacacgcatggaatgcctatgtggtgggagtccacaactactataaaggcatgtctctgttttgtttgagctttagaaaaataggttggcgaatcaaagaattgttttatcacacaatgagcagagatgttaaattcataaaagaccaagcttacaaggataactttcagggcggagaataccgctcatggggaaagcgtggctattactgcttccatcagttcccggtcattgagattcaatgggccagttgggacaataaactgatagctgcagaaaagggcaaggtaatccgtaaaaatccttatgcctacggcgaaaagaagcacaatcccggtgtatcaatgaaggatatcagctacttagtcaacacttcaaaatacatcaaaaacagccggttagccatgttcagaatcagtaaatacagttccatgaaaggtgtcagctatctgtcgggaaattttgtccccgtagacgaataccactgccaccatatcaaaccacttagcaaaggcggaacaaatgattttgaaaacctctgtgtgctttcagaaatggaacatacgatactgcacagcagtaccccggagcggctttattccatttttcccagaaagatacggagaataaaagcacttattgattccttgcaaagagattgattgtgaatatgtcgtttgcttgttgagcaagagacccctttggaatgggggaatcttcacaaagtaagagggtacgccggatgcgctgaaaggtgcccgtccggtgtgggccgggggaaaaggccgagacgaaagtcagagccttacctatcggtatccgtggatctgatgtttgacgcattggaagccgagaagccgaaccactttgcggtgcgccagtataagaaatataagctggcggcaggtgttgtatgctctaaaagacttcttaatcaagcggttgggaagtctcttagaacacacaacctaaaaccgaagaaaggagcgcaagttatgagaaaaaacgagaaaatcactgctctgtacgaacgactgagccgtgatgactttggcaaagatgatgaccagcagcgtgagagcaactccatatccaatcaaaaggctatgctggaggagttcgccgcacggcagggctttacaaacatcgtccatttcacggacgatggcattagcggtacttgctttgaccgtcccggatttttggcaatgatgaaagaagtggaagctgggaatgtggagtacctgtgtatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacatcatgaacgagtattatgccagagacaccagccgtaaaatccgttccactttccagtccaaaggcaagtccggcaagcacctcacaggcacggtcatttacggctatctctggaacgaagccagagaccaatggctggttgaccccgaagccgcagaggtggtcaagcgcatctttgccatgacgattgagggctacggtccgtatcagatcgccagcaagctgaaagaagaaaaaatcctcattccgtccgcttaccttgcccagcacggcgagggcgtgaacaaaaacaagactttcaaagatatgtacggctggggttcttccaccatctgcaacattcttgaaaagcgtgaatatctgggacacaccatcaacttcaagacccgaaagcacttcaaggacaagaaaagccattatgtcccggaggacgaatggacgattttcgagaatacccatgaagctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgcaccaacaacggcaagcgtatttctcaatatacctgctcccaatacagcaaagtcccagttggaaagctctgcacgacacagcaccgtatcaatgaagatgtggtactgtcccttgtctctgaaatgctgaaagccattgccgagtatgcgaagcatgacagagccgagtttgtccgtgtggtgcaggaagcgcagtccagccagcagacagcagaggtcaggaaacagcggacacgccttgccgccgcaaagcagagagtttccgagctggaagtcctgctctgcaaaatctatgaggacaacattttaggaaagctgtccgacagcagatacgccactctggacgctcaatacgaaaaggaacagtccgagcttaccgctgaaatctctgctctggaaaaggctatcaggagttatgaaaagcacgaaaaggacgctgaccgttttatcgctctgatcgacaaatatgagaacttcgacaagctgaccattgccatgctcaacgagtttatcgagaaaatccttgtgcatgagcgtgaccgcaagggcagtatacagaccacacaggaggtcgagatttacttcaattttgtcgggcgatttgttcctccggcgtttggagaagtggaactgaccccggaggaattagaggaaatccgcaagcgtgaggaacgcaaggacaggcttcatcagaactacttgaagcggaaagccagcggagcgcagaagcgatacgaggacaaaatcaagaagcggaaaaaggcagaaatcgaagccaagaaagccgccattcgtgcggaggatattgcaaagggcgtgttcgtcccggtcagcagtttaccgcagagagagccgatgaaaggagtacaaacagcatgaatatcacttacacacagaacggcgattatcttatcccgaacatcattatccgcaagaccaagcccctcgggcactacggcagactccgcaaagcgtatctggaaatgcaccgtccgatactgttcaatgagctggtactatccgacaagctctttgagcattgcgccgagattgacgaagcggcacgaaatcgcatggagctgatcgtgccggagctggtgaagcgcaacggcgtgaccgaacagctgaaagccgaaaaccaaatggaatgggtgcggcagatgaacgcttgcaaggcacaggcagaggagattgtgaaagcggaattgatttatgattgagcgagaaagtccgggcagaaaactgttcggacttttctcatacagtccaaagttgcggtagaattgttcacaagttttatggtataatttgaatacgaaaattgagcaacaaatcgaaatttgcaaaggaggactatgtatgcgtatatggaaagcaatattcagcgtattaactattatttttggctcactgggactgataaacatagtttctactgatataacactgccgattatgtttgtctttatgggattaactatgttgacaaatgcaaaggagtgttatgataaaggtgcgaagaaagatgctatgatatttgcaggcatagcgatttttgtctatgtagtcacagcatataatctgataagcagatttatgtaacttcaagtttgttgcactgataaaatccctttaggaactaaagggcgcacttctatactctctatcgagagtagtgcgtcctgcggagcttcattcccggtcagcagaagaaaactgcccgaccgagaatgtttcgtcacttcgttccgtcaaggtggctacacccccttgcgacgcttgtgcgtctatcccttgtggacttgccgtccgcaaacagcataaaatgctgttcgccgccagcaagtttgatatcaataaatttggaggaacttatgataaaaagaatgatgatggcattatgtatattcgtttgtacctttactttagttgcgtgttctggacaacaaacaaacgaaccacttactttaggtgtcaatgcgataataacagaaattgataaagaaaataaaatcataaccacaaaagatagcgaagaaaaaggtgttttagggaatgattgtcttattgactgttccaaaattccaatgatttattgtaattatgatacacaagatgttgtagctataactcttgatgatttacaggttggggacgaaatcattttgactattcggagttcggaaatagaaaatctccaaaaggaagatgacaataaaacaaaaatagcggttgagcaattacaattaggcacacaaagaattaaataattttcaatttctcatacccagattaacaagtaaatacggaaaatcagaccgttgactggtcgcattatgcgaaaagttgacggtctttttttatcccaaaaatcaaaaaaggaggtcaatcacaatgacaaaaccgaaaacccttgaacagctccgagccgaaaaggaacgagccgagacgcagcttttacaggaacagcacaagctggagcgtctggagaaccgaaagaagtatctggagaaaggcgaacgcaccaagcgcacccaccgcctttgcaatctgggcggcacgattgagagccttgccccggaggtcaaagatctcacacgcaccgaaatgacagagctgatggaacacatcttttctctgtccgaagtccagcgagccgtccgtcacatggcgattacccacatcaacaaagcgaacggaggaaaggagttgaaagccgatggcactatttcatctgagtgtcacgcagactaagcgaagcgcaggacagtccgctatcgcttctgctgcctaccgagccggggagcgattgtatagcgagtattacggcgaatacagcgactacacccgcaagggcggcgtgatctgctctgacattctcctgccgtcccatgcaccgcccgaatacgcagaccgccagaccctatggaacgccgtggaaaaagccgagcgtggaaagaacgcccaacttgcatacagctttgacattgccttgcagaatgaattttcccttgaggaaaacatcgctcttgcaaggcaatttttattggagaactttgtgagccgtggcatggtggctgactttgccgtacaccagccagaccgggaggacggcggcatacccaatccgcattttcatgtgctttgccctatccgccccatcgagcaggacggcaaatgggggctaaagcaacgccgggtgtatgagctggacgaggacggcaaccgtatccgagaccagaacggcgagtttgttttcaacgccgttcccactaccgactggggcagtcccgaaacgctggaatactggcggcagacatgggcggagctatgcaacgccaagtttgcggaaaaggggcttgacgttcgtatcgaccaccgaagctatgagcgtcagggcgtggagtttcttcccaccgtccacgagggcgcaaccgtccgggcaatggagaagaaaggcatacgcaccgagaagggcgagttcaaccgctggatcaaggcaaccaatgccgttatccgggacatcaagaagaaaatcgctctcctgttcgattggattgccgaagcaaaagcggagcttgccaagccacaggcacccgaccttgtttctctgctgaacgcctattacacccagcgcaaagccggggcgtattcccagaaaggcaaaatcagcaacctaaaggagatgaacgatactttcaattatctccgggcaaacggcatttactcccttgaggatttggaacgccgtgtcagcgaacacagtgctgccacagagagcttgaagaaaacgctggacgaacagaccgctcgaatgaaagcaattaagcagctctatgacagctccgctgctttccagagcttgaagcctgtctatgacggcttgcagaaaatcaagtttgagaagcccagagccaagtacaaggcagagcatgaagcggaactcaaacagttctacgccgccagacgaaagctgaccggggagttcccggacggcaaggtggatatgaaaaagctgaccgaagagtatgacgagctggaacaggcgcacaacaccacttatggcgagtttaagaccgtcagagacgatttacaccgtctttggaaggtcaagtcatgtgtagatactgccgcccgatttaacgagcgtacagaggaacaaatgctccaaaatcgaccccaaacacgacacaaaaaggaggaactatcacgatgaattacacccaagcgcagattgaccgggcaaacgccgtcagtctggaagattttctccgcacacagggagagacgcttatcaaaagcggacgggaataccgctggaaagaacatgacagcctgaccgtccggggaaacaaatggtttcgccacagccagagcaagggcggctatcccattgattttgtcatggagttttacggcaagtcctttcccgaagcagtccagctcttaaccggcgaaagcgccgagggacagatcgaagccagcacagcaccgcccacagcgtttcacttgcccttgcacaacagaacagccgacagagcaattcaatatctttgcgaaagccgaggtctcaacaaaacgcttgttgaggcttttcttctttccggggatatttacgaggacgcaaagcggcacaatgttgtgtttgtcggcagagaccgaagcggtacgccgagatacgcccatgtgcgaggaacggcagacccattcagacaggacattgccgggtctgacaaatcctatccgttccactatgagggaaacggcaaccagctctttgtctttgaagcaccgattgaccttttgtcctttatctgcctttatccgcaggactggcagacaaggagctaccttgccctgggcggcgtttcaggcaaagcccttgaccgtttcctttctgaacgcaaggacacccgaaaagtgttcctctgccttgacagcgacaccgcaggaagtgaagcctgcacccggctggcacaggacattcccggcgagatcaccgtcattcgccttgtcccggcaaggaaagactggaacgatgttctccgtcagcaaggggacattcccagccgcaaattcatagccgagacaattacgctgcgagagctgcccaccgcccagcctgtcccaatgctccgtatggcagatgtggagctgacgagcgtggattggctatggtttccgtatatcccatttggaaaactgaccatcatacagggcaaccccggcgagggcaagacctactttgccatgcgtcttgcggcggcttgcaccaaccgaaagcctttgcccggtatggagacaattgagcctttcaatatcatctaccagaccgcagaggacggtctgggcgataccgtcaagccccggctgatggaagcggaagcagaccttgaaagagtgcttgtcattgacgatagggacacaccgctgacccttgccgatgagcgcatagcaagggcaatccgtgagaacaacgcaaggcttgttatcattgacccggtacaggcgtttctgggcgcagatgtggacatgaaccgggcaaatgaagtccgtcccatcttccgcagtctgggagacattgcacaggctactgggtgcgctatcgtgctgattggacacctgaacaaagccgcaggaacgcaaagcacctaccggggattggggtctatcgacattacggcggcagtccgcagtctgctgtttattggcaagctgaaggacagtccgacaacgagggtgcttatccatgagaaaagctcccttgcgccgcccggacagtcccttgccttttctctgggagatgagaaaggttttgagtggataggggcttatgacattaccgctgacgagcttcttgccgggacagacaccgccaagaccgagagcaagaccgcacaggcgcaaatgctcattctggaactgcttgcggacggaaagcgtatgccgagcgcagagttggaaaaggcagtcaatgagcgtgggatttcttcacgtaccatgagaacggcaaagagccgtatcggagacagacttgtgaccgagaaagacggcacagtatgggtctgctatctccgagactgacaacaggaacacggcaagcgtggcaaagacggcaaggtttttatagataccttaatgttgccgccttgccttgttccctcataccgacaccgcccgatgatgaatagttaccgggcactttttcatttacaggaggattttgaatgaacaataccgcaaccaacaccgccacttgcccgactgtcagaaagcagattggcaagaccacctatatcgtccgtgtccatttcagcgagaccgccaaggagacgatggaggacaaaatcaagcgtatgctccgtgaagaagtccgcaaaatgtgacttctttttgaatttgatgaaaaagtccttgacttttcgtctctggaaaaacagccaagtcgatcctaatttcctgtggtgcgcgtcttgccgtgttcgacattgcagagctgcgtgaggtcacggcttatgatgagctggagctagacactctgggagataggaaaactgccctattcctcatcatgagtgatactgacgacagcttcaacttccttatttccatgtgttatacccagctttttaacctgctctgcgaaaaagccgacgatgtgtatggcggcaggctcccggtccatgtgcgctgtctcattgacgagtgcgccaacatcggccagatccccaagctggaaaagctggttgccaccatccgaagccgtgagatttccgcctgtctggtgttgcaggcacagagtcagctgaaggcgatctataaggataacgcagataccatcatcggcaacatggatacttccatcttcctgggcggtaaggagccaaccaccctcaaagagctggctgccgtgctgggcaaggaaaccatcgacacctacaacaccggagagagccgtgggcgtgaaacttcccactctctcaactatcaaaagttggggaaagagctgatgagccaggatgagcttgctgttatggatggcggcaagtgtattctccagctgcgcggtgtgcgtccttttctttcggacaagtacgacattaccaagcaccccaatttccagtacactgccgacgcggatgataagaacgcttttgacattgaagcattcctgtccgcaaggctgaaactcaagcccaatgaggtctgcgatgtatatgaagtagacacagagggcgcttaacttcgttccgcttttgaagggagtgatcttatctattcgccgcacctgccctctaatgggccattggcgtacaaagcggacaatcccaagaaaaaaataatgaaaaaggaggacagccggaatcatgcccccggaaaccgggcggcagattgttccggcttttgtatgcctatgaaacatgacaaacctattttttaatcagattccggctaacaaactatatggcattttttgaacaggcaatcaccgttcttcagaccctcgttatcgcgctcggtgccggtctcggtatctggggcgttatcaacctgctcgaaggttacggcaacgacaaccctggtgcaaatgctcatgtgcggtaaagtaacacacaagaatttgaacaggcagcagcccattattcctaaaaaatcttgacaactattgaacagatgattatacttatcctgtaaattgaataaaatcttcagggcagggtgcaattccctaccggtggtatagcccacgagccgcaaggcatgattcggtgaaactccgaagccgacagtatagtctggatgaaagaagattaagaagcgcaggaaagttttcttttctgcgtgtaaagcgattgctctgggatattttatattccagagctttatatttgcacaggtattccctgcgctcttttgcttttgccttgaacgattttgttcaaggcattttctatttgtggaggtgatactgtgaatgacagtgattatatgaaaatcgcattacagcttgcaaaaaaaggatgcggttttacttctcctaaccctatggtaggagctgtcattgtaaaggaaggacggataatcgggcagggttggcacgaaaaatatggcgaagctcatgcagaacgtaatgcgttagcggcatgtacagaaaatccaaaaggtgcgaccatgtatgtgactttagaaccttgctgccattatggaaagcagccgccctgcatcaatgcaatcatggaagcaggcattgaacgggtagtaatcggttctggtgaccccaatccccttgtcagcggaaaaggaatacaaattctaaaaaaacaagggattttggtgacagaacatattttacaggaggactgcgagaggctcaatgaagtgtttttccattacattcaaaccaagcgtccttttgtagtgatgaagtatgccatgacaatggacggaaaaatttcaactaaaacaggagcgtcaaaatgggtcacgggcgaaacggcacgacgccatgtcgcacagcagcgtcaccgatatgctgcaattatggcaggaatcggaacaatattgacagacgacccacagcttacctgccggatagagggtggaaaaaatccgattcgcattatttgtgacaccacgcttcgcatacctctaagtgcgaacgttgtttccacagcaaagcagattcctacaataattgcaacctgttgcagggacgcagaaagatgtgccttgtatgagaaaaaaggctgccatgtcctgcttgtcgaggaaagaaacggtcatgtggatttagaacagcttatgtatttattaggggaaaaacagattgacagcattttgctggagggtggagggacgttaaattgggcagctctttccagcggtattgtacagaaagtgcaggcttatatcgcacctaaattatttggtggacaggctgcaaaaactccgatagagggagagggcatttgctatcctactgcggctttccgattaaagaatagctgtgttcttccgctgggtgaagattttctgattgaaagtgaggtagagcaaagtgtttacgggaatcattgaggaaatcggaacggttcataaaatcaaaaaaggacagctttccgtcgtccttgaagtttgtgcgaaaacagtgctggaggatatgaaaataggggatagtattgcagtaaatggagtttgtctaactgttacagccctgtactcaggctcatttgttgcggacgttatgcacgaaaccttaaaccgttctgcactggcagcccttatccctggtggtcatgtgaatctggaacgagcaatgtcggcaagcggaagatttggaggacacattgtctccggacatatagatggcacaggcaaaatcgtgtacatacaaaaagatgataatgcggtctggtttaccatacatacaaacccggaaatcatgaggtatgttgtagaaaaaggttctgttgcaatcgacggtatcagtttgacaattgccaaagccgacagagatagattttctatttcagcgattccccataccgtcagacaaacagtattgaatgagcgaaaagagggtgattctgtcaatctggaagcagatatagttggaaaatatgttggaaaattcttgtctttcaaacagaacacggacagtcatatcacaaaggaatttttagagaaatatggttattaggaggatgtcgcatggcagcgtttcataaaatcgaagaggcacttgaagatttgaaaaaaggaaaaataattttagtaacagatgatgcggaacgggaaaatgaaggggattttatctgcgcagcacaattcgcaacaacggaaaatattaactttatggcgacctacggaaaagggctgatttgtatgcctatgtcagaggactatgtaagcaagctcaaaattccgcaaatggtagaaagaaataccgataaccatgaaacggcttttactgtttctattgaccatgtaacaacttctaccggaatttctgctgctgaacgctcaatcaccgcccttgcatgtgtggaggaaaatgtaaagccagaggatttccgtagacctggacatatgtttccactgcttgcaaagaaaaatggtgtgttagagagaaacgggcacacggaagcaactgtagatttatgccggttggctggattaaaagaatgtggattatgctgtgaaatcatgcgtgaagatggaacgatgatgagagcaacagagctttttgaactggcagagcgttttggaataaaatttattaccatacaagatttgcaaaattaccgtaagtgccatgaccatttggtcgagcgggtaacaactgtaaaaatgccgaccaaatatggggattttatcgcatatggttttgtaaataagctaaatggagaacatcatattgctcttgtaaaaggggaaatcggagatgggaaacatattctatgccgtgttcattcggaatgtttgaccggtgatacctttggctccctacgctgtgattgcggacagcaatttgcttcagccatgacgcagattgaaaaagagggacggggtatcttgctctatatgcggcaggaaggacggggtatcgggcttatcaataagctgcgtgcctatgagctgcaagagcagggaatggacacgttagaagcaaaccttgcattaggcttttcaggcgatgaacgggaatattatatcggcgcacagattttacgggatttgggcgtatcaagtatgcggcttttaacgaataatccagataaagtttatcagcttgcggaatttgggcttgaaatcacggaacgtattccgctccaaatggacgctacggcgcacgatttgttatacctcaaaaccaagcagaaacgtatgggacatattctaaaatactaaatcgcaggaggaaaatacgatatgaaaacatttgaaggaaaacttgtgtcaaaaggaatcaaagttgggattgtagcggcaaggtttaacgaatttatcactgctaagttgttgggaggggctatggacgctttgctccgtcatgacgtagaagaaaaaaatattcatgtggcgtgggttcccggagcatttgaaatccctctaattgcgtccagaatggcaaaaagcggaaagtatgacgtaataatttgtttgggggcggttattcgcggctcaaccagtcattatgactatgtatgcagtgaggtggcgaaagggattgctactgtttctctggaaagcggtatacccgtactgtttggtgtacttactactgacagtattgaacaggcgattgagagggcaggaacaaaggtgggaaataagggatatgattgtgctgtcagtgcaatcgaaatggtaaatcttattgaggaaattgaaaaataaatatttttccatagcagaatcagccgagccagtcaacggcaagtgaatgggctgcgcccaccgttgacagccccgtctgtccttgctggtgggtaatcaaggggcgacagtaaaaagtgctaccgccctttcccataatcgaagaaagggggattttccatgactgaacaggaatcctatcaagaacatatccgctatacccatgatacctattgccggattgttattcgccatgcgtcctttgacgctgcccgtatgctggcggcgaggtggaaacgggaaatctcccttgaatatctgaccgaagaaaagtttgtccaactaagcaccacagacgagtattttcaagtgccggactatggcgaaacttatccgttctctgtccgggggaagacgatatttttagatagctattcccttgcggcggctcttgtcgaactgccggaacagacgcaggaggaaatctttttgtattacttccagcacttgacacagaaagaaatcggagaacaaagcggctggacacgcagcacaatcgggcggcatatccagcttgccttaaagcggctgaaagaagaaatggaggtgttgttccatgagcaaccgacttctcccctatgacacgataataaaagcacatgaaggcgaccccatagcgatacaaactgtccttgaccgatatgccggatatatccgctatttctccaaaatgaacggctattataattctgatatggaggactacattagaacaaagctgattgaaagcctgttcaagttccggctggaccgataacataaaaactgaatatcccgccgccccgcagcggcacacgaagcagtaaatccgaaaaagatttgctgctttttttgcgcccatttttggcaaatttccaaaagttccgtattagatagtgaaaccaaaaaaggctgccgttttttcagacagcgggcaaaacgcagcttccgaaacgccttattgtcgggaaagaccgagccgctggaaaagttcttgccggaaagtccgtccattctgctcttttgtggtttgtagggagtaaggggaagaacgccagcccgcagccttttataaaaaagctggttatagatttcccgaaaaagtggcagtaggaagtgaacggcagtccggcagtttcttagagcaagattctaccgcagtaccaaaattcgcttatcgctcattttgcccctgcgggaatcttgttggggagtgccttccccaaaccctgccatgcggcttacgccgcttaaaaatccctcaaaatattttttcggatttttcaaaaacagttccgctttacaccctgtttttctcctattagtgagagaacaccacgcacagaaaggaggttttaccatgcgaaaacgatacaacacgccccaccgcagccgggtagtcaaaacacgcatgaccgaggaagaatacgccgagtttgcggaaaggctttctgcctgcaacatgagccaagccgagtttatccggcaagccataaccggggcagccatacgccccatcataactgtttcccccgtcaatgacgagctgcttgccgctgtcgggaagctgaccgccgaatacggcaggatcggcggcaacttaaaccagatagcccggacgctgaatgagtggcacagcccctacccgcagcttgccgaggaggtacgggcggcggtttccgaccttgctgccctgaagtttgaagttttgcagaaagtgggtgacgctgttggcaacattcaaacatatcagctctaaaaatgccgactatggcgcagcggaagcctacctcacatttgagcatgacgagtttaccatgaagcccacccttgatgaaaacgggcggctgataccgagggaggattaccgcatttcttccctcaactgcgggggcgaggatttcgctgttgcctgtatgcgagccaatctccgctatgagaaaaaccaaaaacgggaagatgtgaaaagccaccattatatcatcagctttgacccacgggacgggacagacaacggcttgaccgtagaccgggcgcaggagctgggcgagcagttctgtaaagagcatttccccggacaccaagccctaatctgcacccacccggacgggcataaccacagcggcaatatccatgtgcatatcgtcatcaactccctgcggatttatgaagtcccgcttctgccctacatggacagaccagccgacacacgggagggctgcaagcaccgctgcaccaataccgctatggaatatttcaagagtgaagtcatggagatgtgccaccgggaggggctttaccaaatcgacctcttgaacggcagcaaggaacggataaccgaacgggaatactgggcggcaaagaaagggcagcttgcccttgataaagagaacgccgccagagaagccgcaggacagccgaccaagcccaccaagtttgaaacggacaaggcgaagctgcgccggacgatacggcaggcactttcccaagctggcagctttgacgagttttcttcccttttgctgcgggagggtgtgaccgtcaaggagagccgagggcggctttcctacctcacgccggacaggacaaagcctatcacagcccggaagctgggggacgattttgacaaggctgctgtccttgccctgctcacgcagaacgcccacagagccgccgaacagaccaaagccatacccgaataccctgtcgcagttaaaaagccgtcacaaggggaaaaaaccgcaaaaaccaccccggcagacaacaccttgcagcgcatggttgaccgggaagccaagcgaaccgagggcaagggcgtgggctatgaccgctgggcggcaaagcacaacctaaagcagatggcggctaccgttaccgcctaccagcagtacggcttttcttccccggaggaactggacgaagcctgttctgccgcctataccgccatgcggaaaagccttacggagctgaagcaggtggaaaagacactggacgggaaaaaggagctgcaacggcaggtgcttgcctattccaagacccgccctgtccgggacgggctgaaacagcagaaaaacgccaaagcaaaagcagcctaccgacagaagcacgaaagcgactttatcatagcagacgcagccgcccgctatttcagggagaacggcatttccaagctgccgagctataaagccctgcaagcagagattgaaacccttatcaaagagaaaaacagcggctacaacgattaccgggcaaaacgggaggaataccgccgcttacagactgtcaagggcaatatcgaccagattttacgccggagcgagccgcagcgcagaaaggagcagagccatgaacggtaatatcccccgcatggactaccgccagtaccgggcagcccgccgccttgtgcatgagtgctgcaactatgacagcgggaactgcctgctgttggaggacagtgagccttgcgtgtgtgtgcagagtatcagctattcgctgctctgccgctggtttactgccgctgtcctgccccttgatgaagcactggaagccgcccttttgcgccgggaaagccggaaacgctgcgctgtctgcggggcgttcttcttccccaagtccaaccgggggaaatactgcccggactgcgccggacgcatgaagcggataaatgccgccaaacggaagcggaaacaaagggggaaatgtcacgctttagggcatttcaaacccgcataaatcaaggcttttttggagggtgtcaaagggtgcgtgatacatttatccttttcccttaaaaacgccccctaaaagcgtaacagaacccacagacagacaccacaaggaggtgaaccctatcgccgattatatgaccgcaggaacggagctgcccgcttacctgccttacccccgtttcctgctggaaacagacctatcccataccgcaagagagttatattcgctgctgttagaccgttccaccctttcacagaagaacggctggcaggacagcgaggggcggacatacattgtctaccccatagcggaaatggcggaagtgatgaaaaaaggcagcaccaccataaagggggcactgaacgaactggacgctgcggggctgttggagcgcaggcggacgggcttctcttgcgccaaccgtctgtatgtgaaagtgcctgccccagtggtacagtttcccgaccaactgacggacggaaaaccgaccctcataagggcaggaaaccgaccaactgacagccggaaaactgaccttatgacggtcggaaaaccgtcccctaaccaaactaatataaacaacctaatagagagccaaacaaaaagagcgagtgaggggcagccccctgccgcttatggcagatataaaaatgtattcctttctgacgcagaccttttgggactggaaaaggactttcccggcaagtgggagtattaccttgaccgcctatcctgccatatcgcttctaccgggaagcggtataaaagccatgcagccaccatttacaagtgggcgcaggaggacgccgccaaagggaagcccaagaaaggcataccggactattcattcaaggagggagaaagcctatgaccgatacaatccacaacaccatactgcctatgactgataccactgtcacaccggaggattacaccggggaggacgggctgttatactgcggcaaatgccacaagcccaaagaagcctatttcccggagggcaagacctttttcgggcgtgaccgccacccgtcagagtgcgactgccagcgggcagcccgcaaggaacgggaagctgccgaaaagcagcgcagccaccttgaaacggtggaacgactgaaacggcagggatttaccgacaagaccatgcaggactggacatttgccaacgataacggaagctgcccgcagatgaagaacgccgccggatatgtggcacgctgggagcagataaaggacgggaactacgggctgctcttgtggggaaaggtaggcactggaaaaagctattttgccgggtgtattgcaaatgccctcatggagcaggaagtcccggtgtgcatgacaaactttgcagcgatactcaacgaccttaccgccagctttgcgggcaggaatgaatatatttcccggctttgcagcttccccctgctcatcattgacgattttggaatagagcgtggcacagaatacggactggaacaggtctataacgtgattgacagccgctaccggagcaggaagccgctgattgtgacgaccaacctcacgctggaggaattgcagcacccggaggacaccgcccacgcccggatttatgaccggctgcttgaaatgtgttcccccctctgctttaccggggagaatttgaggaaagccgccgcacaggggaaaatggaacggctgaaacggctgcttgccggaaaggagatttgcctatgaccgacacccaaagaaacaaacgccctgcccgccgcccggactgcgtgaccgaaacaaggataggcaacacaatccttgtggtgtccggctttttcaaggagggggcgaccgacaccgccgctgacaagatgatgaaagtgctggaagcagaagccgccgccggatatttgagctgcgagaagcctaattgaaaaaccgccatttttaccgactgtaaagaagcagatttgacgcttttgccgctatacagacagccgccccatgtggtacaatcaaggtacggaatagtggggctggctgtcggaaacggaggaatttatgttaagacagaccacccagcaactcattaccgccctttacccaagactttcccatgaggacgaactgcaaggcgagagcaattccatttccaaccaaaagcggattttggaaacctatgccaaacagaatggattttccaatctgcgctggtacaccgacgacggttattccggtgcaaactttcaaagacccggatttcaagccatgcttgcagacattgaagccgggaaagtcgggacagttatcgtcaaggatatgtcgaggttagggcgaaactacttacaagtgggaatgtacaccgaaatgattttcccacagaaaaacgtccgttttattgctattaatgacggcgttgacagcgcacagggggaaaatgactttgcccctctgcggaacatctttaacgaatggctggtgagagatacgagcaagaaaatcaaggcagtaaaacgctctaagggcatgagcggcaagcccatcacaagcaagcctgtctatggctacctcatggacgaggacgaaaactttatcattgacgaggaagccgccccggtggtacggcagatttacagcctttgccttgccgggaacggtccgaccaagatagcccgtatgctgaccgagcagcaaatccccacgccggggacactggaataccgcaggacgggaagcacccgccgctaccaccccggctatgagtgcaagtgggcgacaaatacagtggttcatctgctggaaaaccgggaatatacgggctgtctggtaaactttaagaccgagaaaccgtcctacaagctgaaacacagcatagaaaatcccccggaaaaacaggcagtttttgagaaccaccatgagcctatcattgaccgggaaacgtgggaacgggtgcaggagttacgcaagcagcgcaaacgccccaaccgttatgacgaagtgggcttgttctccggcatactcttttgtgccgactgcggcagcgtcatgtaccagcagcggtatcagacggacaagcgcaagcaggactgttatatctgcggcagctacaagaagcgcaccgccgactgtacggcgcactttatccgcaccgacctcttgactgccggtgtactctccaatctgcggaaagttaccagctatgcggcaaagcatgaagcccggtttatgaagctcttgattgaacagaatgaggacggggacagacgcaggaacgccgccaagaaaaaggaactggaaacggctgaaaagcgtatcagcgaactttctgctatcttcaaacggctgtatgaggacagcgtgaccgggcgcatatcggacgagcgtttcacagagctgtcggcagactatgaagccgagcagaaagaactgaaagaacgtgccgccaaactgcgggaagaactttccaaagtgcaggaagccaccgaaaacgctgaaaagtttatgaacgtggtacgcaggcacaccaccattgaagaacttacccctactctgctgcgggagtttgtggagaaaatcgttgtccatgaaagcgttgcccttgacgggaaacgccggggcaagttacgcagacaggaaattgaaatctattattcttttgtcggcaaggtagaattgcccgacacctaaccgcccgacctatccgacatacctcatgtgccggataggaacggcaaaattttttacacttcttttacttctttatctcacatgaactaaatcacagggcatgaagcagctcatggccggcgctggtgtagccgtggtcggcatggtccttgtacctctgctctccgggctgttctctgtctaagcgtccctgcatgaaatccttgccgctcccgcagttttgcgggggcggcggaaaggaggttgacaccgtatggatttcttacttgaagccctgacaaattggctgaaagaaatgctggtgggcggtattatgagcaacctttcggggatgtttgacagcgtaaaccaacaagtcgcggatatatccgtacaggtaggccagaccccacagggatggaatggcagtattttcagcatgattgagaacctgtcaaactccattatggtgccgattgcaggcgtgatcctggctatcgtgatgaccgtagacctgatccagatgatcgcagacaagaacaacctgcatgatgtggacacctggatgatttttaagtgggtgttcaaatcagccgccgccatcctcattgtcacaaacacatggaatatcgtgatgggcgtctttgatatggcgcagagcgtagtagcgcaggcagcagggatcatcggttcggatgcgtccattgacatttcttctgttttggcagatatggagccgagacttatggaaatggatctgggaccgctattcgggctttggttccagtccctctttattggcattaccatgtgggcgctgtatatctgtatctttatcgtcatttatggccgtatgattgagatctaccttgtcacatccgttgcgccgcttccgatggctgccatgatgggcaaggaatggggcgggatgggacagaactacctccgctccctgctggcgctgggctttcaggcgtttctcatcatcgtctgcgtggcaatttatgctgtgctggtgcagaacatcgctctggaagatgacatcatcatggcaatctggagctgcgtgggctacaccgtactgctgtgctttacgctgttcaaaaccggcagtctcgcaaaatcagtctttcaggcgcactaaaggagggttctgtatgaaaaaatatcaaatcatttacgcagacccgccatggaactacaaagtatattccaagaaaggattgggacgcagtgcagaaagtcactatccgaccatgagtatcgaggatatttgtgcgctgccagtaggcaacttggcggataaagactgtgccttgtttttatgggtcacgattccatgtttactggaaggtctctcagttctgaaggcatggggatttacctataaaaccgtcggctttgtttgggtaaagcaaaatcgaaaggcagatagcttgttctggggaatgggatattggacgcgctccaatgtggaactttgtatcctcgcaacgaaaggacatcccaagcgtataaacgcagctgttcatcaggtcattgtctctcacattgaagaacattcaaaaaaaccgcaggaagccagagaacgcattgtctcattgatgggtgatctcccgcgcatagaactgtttgctcgtcaatccacacccggttgggatgtgtggggaaatgaagtggacagctctatttcattcccataaaggaggtggataatatggcttatgtacccgtacccaaagatttaaccaaagtcaaaaccaaggtcatgttcaatctgacacgaaggcagctggtctgctttaccgccggggcgcttgtaggtgtaccgctgttcttgtggctccgtgagcctgcgggaaacagcatggctgccatgtgtatgatgctggtcatgatgcccttcttcctgctggcaatgtatgaaaagcatggacagcccctggaaaagatcgtcggcaacatcctcaaagtagctgtgatccgtcccaagcagcgtccctaccagaccaataacttttatgccgtattaaagcggcaggaaatgctcgataaggaggtgtatgacattgttcaccgcaatgaaaagctggctgcgccgtctgctgggaaaaccggaagaaaagaccgtgcatccggtaaagacaaagaaaaagctgtcccgcgccgataagaagcagatcgaagcggccattgcccgcgccaaccgcacggacaaaaaaggaaaatcggcacaggacagtatcccctatgaacgaatgtggccggacgggatctgccgcgtatcggacagccactacacaaagaccattcagtttcaggacatcaactatcagctctcccaaaatgaagataagaccgcgatctttgagggctggtgtgatttcctcaattatttcgacagctcgattcacttccagctgtcttttttgaaccttgcggcatcggaggagacctttgccaactccatttccattccgccccagggggatgcctttgacagtatccgtgaggaatataccacgatgctgcaaaatcagctggccagaggcaacaacggtctcatcaagaccaaatacctgacctttggtatcaacgctgacagcatcaaagccgccaagccccgtctggagcgtattgagaccgatatactcaataacttcaagcgtcttggtgtagccgccagaacattggacggtaaggaaaggctttcccagcttcatgcggtattccacatggatgaacagctcccgtttcagtttgaatgggactggctggctccttccggcctgtccacgaaagattttattgcaccaagctcctttgagttccgcaccggcaagcagttccgtatgggcaagaaatacggggctgtttcttttttgcagattttagccccagagctgaatgaccgtctgctggctgattttctggatatggaaagctcgctcattgtgagtatgcacattcagtcggtggatcaggtgaaagccatcaaaacggtaaagcgtaagattaccgatctggaccgcagtaagattgaggaacagaaaaaagcagtccgcgccggatacgacatggacatcattccttctgaccttgccacctacggcagcgaagcgaaaaagctgttgcaggatttgcagagccgaaacgagagaatgttcctggtctcctttttggtgctgaacacagcggacaccccccgtcagcttggcaacaacatctttcaggcaggctctattgcccagaagtataactgccagctgaccagactggacttccagcaggaagaagggctgatgagctgtctgcccctgggactcaatcagatcgagattcagcgagggctgaccaccagttctacggctatctttgtaccattcaccacacaggaattattccagaacggcaaggaagccctgtactacggcatcaatgccctgtccaacaacctcatcatggtggatagaaagctgctgaaaaaccccaacggcttgattttgggtacgccgggttccggtaagtctttcagcgccaagcgtgagattgccaactgctttttgcttaccaatgatgatgtcatcatctgtgacccggaagcggagtacgcacctctggtggatcgtctgcatgggcaggtcatcaagatctcgcctacctcaaccaactacatcaatccgatggatctgaacctggactattcggatgatgaaagcccgctgtccctcaagtctgactttatcctcagcttgtgtgagctgatcgtgggcggtaaggacggattgcagccggtgcagaaaaccatcatcgaccgttgtgtgcgtctggtctatcagacctacctcaatgacccgcgcccggagaatatgcccatactggaggacctatataacctgctccgttcacaggaggaaaaggaagcccagtatatcgccacggcccttgaaatctatgtaaccggctccctcaatgtgttcaatcaccagagcaatgtggacatcaataaccgcattgtctgctatgacattaaggagctgggcaagcaactcaagaaaatcggtatgttggtggtccaggatcaggtgtggaaccgcgttaccattaaccgcgctgcccacaagtccacccgttattacatcgacgagatgcacctgcttttgaaggaggagcagaccgccgcttatacggtggaaatctggaagcgattccgcaaatggggcggtattccgacaggtatcacccagaatgtcaaagaccttttgagcagccgcgaggtggagaacatctttgaaaactccgacttcgtgtatatgctcaaccaggcaggcggagaccgtcagattctcgccaagcagctgggcatttccacgcaccagcttagctatgtgacccactccggtgagggcgagggcctgctgttctatggctccaccatcctgcccttcgttgaccacttcccgaagaatactgagctttaccgcattatgaccaccaaaccccaggaactgaaaaaggaggatgaataactatgaaacagaatatttgcgaacttgataccatgatttttttccgtgaggcattggaggctcacgaattcatgttgcttccggtaatggcctccgctgttgttgagtgtcgtaccgctgacaaagaactcaaaaccttgaatgaggatggcgaaattggtcttgcccgtctcttttcgatttgggcgaatatgatgtgtgcccctggtgcagcaaccattgtagggtgcagacctatcacaatgctctctgagattctggcgcaagtccatgcgtatctcaccgtgcatccgctatatgatccggaaggtttggccctctatgtggagctgcaccacatgatggatgctatcctaatgggtgattggtttgaataaagagccgcgcctgcgctttactgatgaggaacgggctgaccctgcactggaaaagccgatccgcaaaacggagaaagctacggccagagcagataaggcgcaggccaatattccaaagaaaaaagtcagacagacggtcattgacccggacaccgggaaaaagacctcgaagctgacctttgaggacaagaaaaaaccaccttccaaactttctcaaggggttaaggaagctcccgtccatctggtcgcgggcaagtttcacaaagagatccgggaaacagaacaggacaatgtgggcgtggaaagcgcccacaagtccgaggaggcggtggagaccagcgcttatctggtgcgggagggctatcgcagccacaagctgaagccgtaccgcaaagcagcccaggccgagcagaagctggaaaaggcaaatgtaaatgccctgtaccagaagtccctacgggaaaatcctcagtttaccagcaaccctctctcccgctggcagcaaaaacagagtatcaaaaagcagtatgccgtcgccaagcgcaccggtcagactgccggaaataccgcccaggctgcgtccaaaaccggaaaagccgcaaggacggtaaaagaaaaggcacagcaggcaggggcattcgtcatgcgccacaagaagggcttcctgatcgcaggggttttgttcctcatcgcctgtatgctgatgaataccatgttctcctgctctatgatggcacagagtattggttctgtaatttccggcactacctatccatcggatgacccggaaatgctggcggtggaggcagattatgcagacagagaagctcggttgcaggagaaaatcgacaacatcgaaagcagccacccagggtatgacgagtatcgctataacctggatatgattggccatgacccccatgagctggcggcagttctctctgctgtcttgcaaggctatacacgccacagcgcacaggcagagctggatcatgtgtttgatgcacagtatcagcttacgctgagagaagaaattcagattcgcacttacactgacgaagatggtgatgagcatgaatatgaatatcgtattctccatgtaactttaacaagccgttccattgcctctcttgcgccagaactactgactccggagcagatggagatgtaccaggtctaccgacagactatgggcaataagccgctgttatttggtggcggttctcccgatacaggtgtttctgaagatttgactggtgttgaatttatcaatggcacccgccccggcaatccgcagctggtggaactggcgaaaagtcaggtgggcaatgtgggaggacaaccttattggagctggtacggctttgacgcccgtgtggaatggtgtgcctgctttgtatcatggtgctatggtcaatccggtcgaacggaaccacgctttgctggttgtcagtctcagggtgttccgtggttccagtctcatggacagtggggcgcacgaggatatgaaaacatcgcccccggtgatgccattttcttcgattgggatctggatggttccgcagaccatgtgggaattgttgtcggcaccgatggcagccgtgtttataccgtggagggaaattccggcgatgcctgcaagatcaaaagttatgacctgaattatcagagtatcaagggctacggcctgatgaactggtaacagagattttttagaaggagtgatagacgatggcaaagaacaaaattgaacgcattgaccaggagattgctaaggtccgcgagaagatcgcagagtatcaggaaaagctcaaggcgctggaggtacagaaaaccgaggcagaaaatctggagatcgtccagatggtgcgcgcactgcgtatgaccccggctcagctgagcgccatgctgtccggaggcacagttcccggcagttttgctgatgacaacaacgaacaggaggaaaacagctatgaggaataaacgattgctccgaacactttccgccctttgtctgacgctggtgctggcatcgggctttaccgttcccgcttttgcccagggcgcagcgccgcccccggcagaggataccaccaatgacagcaatgtggtggtggaagaaacggaaaaagcacctccgctgaccccggagggcaacgccgctctggtggatgatttcgggggcaataaacagctcattaccgttaccaccaaggcgggcaactatttttatatcctgatcgacagggccaacgaggataaaaagactgctgttcactttctgaaccaggtggatgaagcggacctgatggcgctgatggaagatggaaaacccaaagaggagccgcctgctgtgtgcagctgcacgaagaaatgtgaagcaggggcagttaatacggcctgtccggtctgtgtaactgataagagtaaatgtacgggaaaagcaccggaacctccggcagaaacaccggagccggaaaaagagaagcctgccggactgaacccggctgcgctgatccttctgctggctctgctgggcggcggtggcgtatttgcctacttgaagctcgttaagaataagcctaagaccaagggcaatgacagtctggacgattatgattatggtgaggaagattccgaggaatgggaaaccgaagatgaggaagtccttgaggatggttttgagggttctgaccctaatgaggaacgcgatagagcagattgaaccatttgagcgtagcgtatttcaaatcattgcgggataagggacagaggacagggagaaattcctgtcctctgctgctctactcactctcttactgtaaatccacacccaaaatcagcacatggtcaaagaaaggaggacctcacaatgaacacatggaactggttattacactttctgattatttttgatctggtcgccttcggaatttactttggaggagacattcttttcactgctatcagcaaagttcaaaaaaagtcaaagaaggacgatgacttggatctttatgattttgaaattgagaccgcaccccaaaagcgctctttatgtgtggactcaatccgaatgctttattctggtgagatagatgaatttgtggaaaaggaactgttgcctgatgcagcggagaccatgaacgctttatctgaagctgaaaaaacagcagttagcctgttactaaaagcttatatcggttttttgagcgaagaagcaacggtagatgaacaaagttttcccatggttaaggaactgttgtcttatacacagggcagcaaagaagatggtgaaaaagatgccatagattgtctgatggaagatacggtcagcagaacccacagacatcgagaatattacaacaattatcaacgctatcaactgatgcaggtggataaagagcgtgtgattatggcctgcaatatcataatcaatgatttgattggcaggttgtaccgatatgattatcgctttggctatgacattacacttgcctcagaacacagcattgcaaaaaaactgtctgataattggcagaatgaatgggaggttgaagattatgaagctggtgattgctgaaaaaccatcggttgcacaaagtctggcggcggtgatcggtgcaactgcccgtaagaacgggtatctggagggcaacggctggcgtgtcagctggtgcgtgggccatctggccggtcttgcggatgcagacagctatgaccccaagtacgccaagtggcgatatgatgacctgcctatcctgccggagcattggcagatggtggtgggcaaagataaaaagaagcagtttgatattctcaaaaagctgatgaatgccccggatgtgacggaagtggtaaatgcctgtgatgccggacgcgagggcgagctgatcttccgcagcgtctacgagctggcaggttgccaaaagccgatgaaaaggctctggatttcttcgatggaggactccgccataagggagggctttgcaaacctgcgccccggtgcggactatgatgaacttcgggatgctgccctctgccgtgccaaggcggactggctggtggggatcaatgccacaaggctgttttccgtgctgtaccaccgcacactcaacatcgggcgcgttatgtccccaacgctggcactcattgtccagcgagaagctgagatcgacacctttaagccggttcccttttataccgtggcgctggagctgcccggtcttaccgtatccggggagcgcatggcggataaggctgctgccgagcagctgaaagaagcctgtcagggtgcaaatgtcacaatcaaaaagatggagcgcaaggaaaagtccgaaaagccgcctgccctctatgacctgactgctctgcaaagagatgccaaccgcctgcttggatttacagcccagcagaccctggactatctgcaaaacctgtatgaaaagaagctttgcacctatccccgtactgacagccgctatctgaccggtgatatggcagacagcctgccggtgctggtgaatctggttgccaatgctatgccgtttcgcaaagggatcgccattacctgtgactcccatgcggtcatcaacgataagaaagtaactgaccaccacgcggtaatccctaccagaaatctcaaggatgcagacctttctgcccttcctgcgggagaaaaagcggtgctggagctggtggccctgcgtctgctgtgcgccgtagcccagccccatatctattcggaaaccgttgtgattgcagcgtgtgccggtggggagtttaccgccaaaggaaaaacagtgaagcaccccggatggaaagcactggaggacgcttaccgtgccaaaacgaaggatgcagagccgaaaaaagagggcgcagagaaagccctgccggagctgaccgaaggacagaccctttcggttgctgctgcaatcatcaaagaaggcaaaagcagtcctcctcagcgctttacggaggacaccctattgtccgcgatggagactgccggaaaagaggatatgccggaggatgccgagcgaaaaggtctggggacaccggccactcgtgccggtattttggaaaagctggtatctgccggttttctggaacgaaaaaagaacaggaaaacggtgcagcttctcccttcccacgatgcagtctccctgatcacagtcttgccggaacagctgcaatcgccgcttctgactgccgagtgggagtaccgcctgggcgagatcgagcgcgggcagcttgccccggaggagtttctggacgggatcagcaccatgctgaaagatctggtgggaacttatcaggtcatcaagggaaccgagtacctgttcactccgccccgtgaggtggtgggcaaatgcccccgctgcggcggtgaagttgcagaattgcaaaaaggcttcttctgtcagaacaaagattgcaaatttgcaatctggaaaaacaacaaatggtgggctgccaagaaaaaacagccgaccaaggctgtggtgtctgcactgcttaacgatggccgtgtccgtgtgacgggcctatattcggagaaaaccggaaagacctacgatgccgctgtggttttggaggatgatggacagtacgctaacttcaagctggaatttgaccagcggaaaggaggcagccgatgaagctctctttagcggaacgggaaaccattctcctctataatcaggcagaaccaatggctgagatctatacccatgatccccgtctgatggagaagctggatctgctggcaaaaaagcaccccgaccagatcacccgaaaggacgcccataactttaccgtcccaaagcggtgtgtatcagtccgggagccatatagcgcagaacgccgcaaagccgccagtgagcgtgcgaaagccgccggataccagcctcctatgcgaaagtccggcagttaaaggcacatgacagagaatgtatttgaagcagtcaagcagtcggtcagcaccagagatgcggcagcgttttatgggatcgaggtcaaacgaaatggcatggcctgctgtccctttcacgatgataagaacccaagcatgaaggtagaccagcggttccactgctttggctgcggtgaagatggggatgtgatcgactttaccgcaaagctctttgacctctcctcaaaagaagcggcggagaaactggcacaggactttggcctgatctatgacagtcaggcccctccccgcaggagatatgtccggcagaaaaccgaggcacaaaagtttcgggaggaccggcagcggtgttatcgcgtactgtccgattactactatctgctgaaaaaatgggaggccgacaattctccccggacactggaggaagaaccgcacccccgttttgtggaagcaatccagaaaaaaatctatgtagagtacctgctggacctttttctgtatgaaagtgaagaagaacaaagggcatggattgcagaacacacagcagaaatcacacacttggaaaggagattgaaaatcatggctgagaacaaacccaccaaccgagagcggctaagggaaatcacagatggcatcgagcagggcatcaaagaactgtttgagagtgaaaagtatatgcgctatctgtccgtcatgtcccgcttccaccgctattcggtaaacaacaccatgctcatctatatgcagaagccggacgccactttggtagccggatacaataagtggaaagaccagtttgagcgtcatgttaaaaagggagaacatggcattaccatcatcgcccccacaccgtacaagaagaaaatcgaggagcagaaactggacccggataccaaggctccgattctggataaagacggaaagatcatcacagaggaaaaagaaatcgagatccccatgtttcgcccggtcaaggtctttgatgtgagccagactgatgggaaacctttgccggagcttgcttcctccctttccggcaatgtgccaaattatgaggcattcatggaggctctgcgccgcagcgcaccggtgccgatcacttttgaagcaatggccgccgatacggacggctatttttctgccgatcatcagaaaatcgccattcgtcagggcatgagtgaggtgcagacggtttcggccacagtacacgagattgcccacagcaagctccacaatcagaaaaagattcagattgccaatgacgagcaatatcaggagatcgagctgtttgataaacccggtctgttctccaatgggcggattgcccgtgataatctgccggagggcgtttattgctatgacctgcgcggttctgactacgaccccggagagccggtctgtgtagaagaacaagtggttgtaaaccatgcaggttccgttctgctgacagagccgttggagctggcggaagatggacgcctgatgctgaccgaggaagaagggctgaattttgttggcggcttttctaccctcgcccagtttttgcaagaacagaggaaagaccgccacacggaggaagtggaggctgaaagcatctcctacgcagtctgcaaatattttggcatcgagaccggagaaaacagcttcggctatattgcaagctggagtcagggcaaggaactgaaagaactgagagccagtttggagaccatcaacaaaacctccggcactttgatctctgacattgagcgccactataaggaaatatgcaaagagcgtgggattgatccccatgcaaaggcagagccggaaaccgccccgatagagcagccgaccggcaatctaacctactatgtagcagagtgcatggagtttccaaacctcggagaataccacgataacctgtctttggaggaagctgtacgcatttatcaggagattccggcagagcgaatgaatgggatcaagggcattggttttgagctgaaagacggaagcgattatgaaggaccttttccgattttgaccggccataccattgacctggacaccatccaggcaatcgactattatcgtgacaatccgctggtacagaaagcggtaaaggaactggctgcggccatgccggaaatggaggtgctgggggcggacgccaaccagcaggaggctttgtttctgatcgacgatgccacctatcttcatatccagccctgtgacagcggatgggactacaccctttacgatgctgcgtccatgaaagagatggatggcggtcagctggatatgccggaactttcccgcatgaaggcagttctccagatttgtgatgacaacgatttgggcaaagactcggtaaaatacgcaccgttgtccatgatcgagaccttgcaggaagcggcctatcagcagatgcaggcagaggtcagtcagatgactgcttcttcccagctgccggaggcacaggagcaggcgctggatgaataccccatgccggatgagcaggtctccacaccggatatgctgaaatacggctactcctatgatgggatgctccctgttaccagagaacgggcgctggaactggatgccgccggtttgactgtctatgtgctgcatgaggacaatacggagagcatggtgtttgacccacaggagatcatggagcatggcggtctttgcggtgtggaccgtgaggaatgggagaaaagccctcagttccatgaaaaggtcatggagcgtcaggaacatcagcaggaacgagaacaggcatttctctcccagaatagagattgctttgccatctatcaggtaaagcataccgatgaattgcgtgacattcgctatgaagggatggactggctccgatccatcgggcaagcagtaaagcgtgaaaactatgatctggtctatactgcgccgttggaaccctgcaattctccgcaggctgctgttgaacagctttataatcagttcaacaacgatcatccggcagactaccaccatccttctatgagcgtcagcgacatcgttgcgatcaagcaggacggtaaggtatcctgtcattactgcgacagcgttggtttcaccgagattcccggattcctgccggacaatccgctgaaaaatgcggaaatgatgctggaggatgactacggcatgatcgacggcatcatcaacaacggcccaaaagagccgaccgtggcgcagctggaacagcaggcccgcagcggccagccaatctctctcatggatttagcggaagctgtccaccgggaggaacgggacaagaaaaagtccgtcatggagcagctgaaaagccagccccggacggaacacaaaaagacagcgcctaaaaagagcgcagaaagggagatttgatatgggaaactttacttttgaagaaatgaacctgatgtgcatttacaacaccggcagccgcaccgggctgatggaggctctgaccgagatgcgcggcgaactttcgccggaggaaacggaactgagggaattgaccgacagcgctcttacgaagctctgtgcgatgactgatgagaagtttgccgaactggagctgtacccggattttgaccagtaaacaacataaccgcagggatggggtggcgatctgccaccccgcctttttaccccaaaactgaaaggaggacagaacaccatgccaaccaaagctgaactatatgcacagatggcggacaaggtggcaacacagctcacggggagctggcaggaatgggcagggtttctcaccactgcttcccgtctttacaagtacccgttccatgagcagctgatgatctacgcccagcgaccggacgccaccgcctgcgcagaatacgatttgtggaatgaaaagatgggccggtatgtaagacgcggctccaaggggatcgctctggtggacgattccggggacagaccccgcctgcgctatgtttttgatatttccgacaccggaacccgtgaacattcccgcactccctggctgtggcagctggaggagcgccatttggattcggtgcaggtcatgcttgagcgcacctatgatgtttccggtgatgaccttgccggacagctcaccgaggtagccggaaaactggctgaggaatactggacggagcatcagcaggacttcttttatatcgttgacggttcctttttggaggaatatgatgagtttaacatcggagtacagttcaaggcagcagccaccgtcagcatcacttacgctttgatgtcccgctgcggactggagccggaacgctacttcgaccacgaagatttcatggcaatctttgatttcaataccccgtccaccatcggggcgctgggaacagcggtcagccagatcaaccagcaggtgctgcggcagatcggcgttaccgtccgaaatgcagagcgcgaagccaaccaagaaaggagcaaacaagatgaacaatcccatgacctatatccagaacggagactatctgattcccgacctgaagctgagccagcagccggagaaacccctgggcaagtacggaaggatgaggaaaacttacctgaaagaacatcgtcccatcctctacaaccagatgttgctgagcgagaagctgtacccgcaccttctggagatcgacgagaccgcccagagcagactggagcagatgatgccccagctggcgaaggaagcgggagccaccgaggaactgaaagccagcgatcccatgaagtgggtggggctgatgaacaactgcaaagcccaggccgaggaaatcctgatggcggagcttatcaacagctgactctaaacctgttcctctccgaagcggaacagatccaatccatagatgaagcagagaatgtagcgcatacatcctctgctttttcttttgcccaaaatgacatcgaccatgtgctgcgtttgggcggcaatacagaccgtcaaagggagcgtgtggttgcagcctttgaaaagcagaaaaccaccgctgagatttccgagatactgaaaacgctgtaccacggcggcaatggccttggcagtgtgagcgcatggtatgccgaggatggtatccatctttcccatgggaagtctgtccgttatgacaggtctgcccaggtcatttcctgggagagcgccgcagagcgtatcggggagcttttggagagcggccagtttgcctccaatgtggagcttgcagaagcggcaggctatgaacgctccctccttgcagaaaagctctggtatctgtaccacgatttcagcgaggaagccagagaagcaggatatttgtcttgcctgtcagaaatcagaggcaatgggttcccggaggagacccgccgcctgacggagcagttgaatgacccggctttccgccagacactcaaggaagaatacgccgccttctggactgcctatcagcaggaccgtgacctgttgcgctttcattaccataggccaagggaaatctgggagaacctgaaagaccttgacctgccccgcaggactttttcttcggacctttcccaagtgccaaccgtccagcatttcattacagaggatgagatcgacaccgccatgaccggcggcagcagttttgccggaggaaaaggccgtatctatgcgttcttcatggaaaaccatacggataaggaaaaagtgagattccttaaagacgagtatggcattggcggacgctctcatgccctgtccggcgcaacacacagcggcgaagatcacgatgggaaaggactgcactataaaaagcaggactgcccggatgttcacttgaactgggaaaaggtttccaagcgcattacctcacttgtccagaaaggccgctatcttaccgaacaggaacaagcgcagtatgacaagatccaggctgaaaaggatctggcagaagaagatgccattcaagcccagcagccggagatagaggaagaaacgccaaagcctacccttcgggagcagtttgagcagtataagcctgtggtgactgccgccatatctgaggatgtggcatatcgaaatgcctgcggtcattccgaccgtgaaaatgctgtcatcgagggcaatgccgctgtgcgccgtgcggttcttggctctaaggatatggagctgatccgcctttattcggatgtgccggagttccgccagcgcttgcaccgggaagtgatcgacgagacctatccaaagctccatgagcttctgcgccctctttctcaggaagatattgatactgtcctttgtgcatggaacggcaatatcgagagtaaacacgctgtcgtccgctatatgaaagaccatgcaagagagaaggataccgctgcatggctggctcaggaatacggtggcagcaacagcccgttcgttgtccgtgccggcagcccggaggaaacacagctgccctggccgaaggtacagcgcaggcttgcccagctgattcaggaggaccggttctataccgaagaagaacaggatcgttttgacaatatcgaccctatcgccatccgggaagccctggaggaaagagggattgtcaatggacaggtggcagacccggaaaaactggacaatgactcatttatccagcaggtaatgtcggatgtagagcagatcgcagctgttgagacagagcagacttccaaagttgctatttccgatgaggaatatgacgcagttcgccgcccaattccgcaaagaacctcctatgacccagccgccccggtctatgccgtgagcgataccgtgtatatcgaggatgacgcctatcagatcaccgagctgcgggaggacaccgtacagcttctgcccaccgggatggtatatcccatctaccgggcagagcgcaaagaacagttcgagcagctgcttcgggcagaccgtcgcaatgcttactataccgagtttcttcctattgacccggacaaggcagatcaggacttgcgggatgtattgtcccatggactgatggatgaagcagataaacagcagctttccacgctacttcaatctggcaggagcaacagcgagatcgcctactggctgagtagaaactatccccgtgagatcgagaccctgaatctggagaccggcgatattgccgattaccgtaccacggcacaaggcatggagctggaagtcatggatgcagaggaaaagcgtctggctgtgctgtatttccgctgggatgaggttgcgcctttgctgcgcgggatgtatgcccgtcagctggatggctttggacaagaacagccccaaccgtctgccgaatccccagcctttcattccgagaccgtggccgtctattcgggcgataagaaccatctaccttatgatgtggtggtggaacggttgcatattgaggagccggagctgccagcccctgtaacagagccggaaaaaacctttgaggaagtgttggatgaacacccggtttccattcaggtcaacggccagtggcagaccttccccaatgccaaagctgccgaggaagcctcctatgaggaatacaaggctaacctgcgccgcaatgcacagaacttccgcattaccgatgagcatttgggcgaaggcggtccaaaagccaagttccaggcaaatgttaatgctattcgtttgctgaaagagctggaatctgccggacagcaggcaagtcccgaacaacaggagattctttcccgttatgtgggctggggcggtattcctgatgcttttgacccagagaaaccggcatgggcttccgagtatacccagctgaaagagctgctgaccccggaggaatatgccgccgccagaagctctatcctcaatgcccattacaccagccctacggttatccaggcaatctatgaagcggtggggcgcatgggctttgagaccggaaatattctggagccgtctatgggtgtgggcaatttcttcggtatgctgccggaggaaatgcgaaacagccgtctgtacggcgtggagctggacccggtttccgggcgcatcgcaaagcagctctatcccaaggcggacatcacagtaggcggctttgagaccaccgacaggcgtgacttctttgaccttgccatcggcaatgtacctttcggtcagtatcaggtcaacgacaaagcctataacaagctgaatttcagtattcataactactttttcgccaaagcactggatcaggtgcgtcccggcggcgtggtagcttttgtgacctcccgatataccatggacgccaaggattccaccgtgcgccgctatcttgcccagcgtgctgagctgatgggagctatccgtctgcccaatgatgcgttcaaaaagaatgccggtgccgaggttgtatcggacatcatctttctccaaaagcgggaccgtccgctggacatcgtgccggaatggactcagaccggacaaacggaggatgggtttgccatcaaccggtattttatcgaccacccggaaatgatgctgggcagacaggagccggtaagcactgctcatggtatggactacactgtgaatcctatcgagggactggagctttccgaccagctgcatgatgccgtgaagtacattcatggcacttatcaggaggcagagctgccggagctgggcgaaggcgaagccattgacacctccattcctgccgacccaaatgtgaagaactattcctatgccattgtagacgggcaggtgtactaccgggaaaacagccgcatggtgcgccctgacctcaacgccaccgccgaagcccgcgtgaaaggtcttgtgggactgcgtgattgtgtgcaggaactgatcgaccttcagatggatgcagcggttccagacagcaccattacccaaaaacaggcggaactgaaccggctctatgatagcttttctgccaaatacggtctcatcaacgaccgtgcaaatcggctggcctatgcagatgattcttcctattacctgctctgtgcgctggaagttatcgacgaggacggaaagctggagcgcaaggcggatatgttcaccaaacggaccatcaagccccatcaggcagtggctactgtggatacagcaagcgaagcactggcggtgtccatctcggaaaaagcctgcgtagatatgagctatatgagtcggcttagcggaaaaacaaaagaagaactggagggagaactgcaaggtgtgatcttccgtgtaccaggacagctggaacaggacggatcgccccattatgtgactgctgatgaatacctttccggcaatgtacgccgcaaactgcgtcaggcgcagcgggcggcacagcaggactcttcttttgcagtcaatgtggaagctcttaccgccgcccagcccaaagacctggatgcgtcggagatcgaggtgcgtctgggcgctacctggatcaacaaagaatatatccagcagtttatgtatgagaccttcaacaccccgttttatctccagcgcagtatcgaggtcaactattcgtcctttaccgctgaatggcagatcaaggggaaatcttctgtatcctacaacgatgtggcagcttataccacctatggaaccagccgtgccaatgcctacaagatcttggaggacagcttaaacctgcgtgatgtgcgaatttatgacaccattgaggatgcagacggaaaagagcgccgcgtgctgaacgccaaggagaccactctggctgcccaaaagcagcaggctatccgggaagccttcaaggactggatctggaaagatccggagcgccgccagactctggtgcgccagtacaacgaagaaatgaactccacccgtccccgtgagtatgatggcagccacattacctttggcggcatgaacccggccattaccctgcgggaacatcagaaaagcgctatcgcccatgtgctgtatggcggtaataccctgttggcgcacgaggtgggagcgggcaaaacatttgagatggtagctgctgctatggaagccaaacgcctgggcttgtgccagaaatctctttttgtggttccaaaccacctgaccgagcagtgggcgtcggagtttctgcgcctctatccctccgcaaatatccttgtcacaaccaaaaaggactttgagacccataaccgcaagaagttctgcgcccgtatcgcgaccggtgactacgatgccatcatcatgggacacagccagtttgagcgtatccccatcagccgggagcgtcaagaacggcttctctatgaacagatcgacgagatcaccgagggaatcgcagaggtgcaggccagtggcggcgagcgttttaccgtcaagcagctggagcgtaccaagaaatcgttggaggccagactggaaaagctgcaagccgaggggcgaaaagacgatgtggtaaccttcgagcagctgggtgtggaccggctgttcgtggacgaggcccacaactataaaaacctgtttctatacacaaaaatgcggaatgtggcaggcttatccacatcggacgcgcagaaatcctccgatatgtttgccaagtgccgctatatggatgagatcaccggaaaccgtggcgtgatttttgccaccggaaccccggtcagcaactccatgaccgagctttacaccatgcagcgttaccttcagtatgaacgcctgcaagagctgaacatgacccacttcgactgctgggcttcccgatttggggagaccgtcacagcattggagctggcaccggagggaaccggctaccgggcaagaacgagattcagcaagttctttaacctgcctgagctgatgaacctgttcaaagaagtggccgacattaagactgctgatcagttaaatctccctaccccggaagtggaataccacaacatcgtggcacagcctactgaacatcagcaggaaatggtcaaggccctttcggagcgcgcatcgcaggtacacagcggcagcgttgacccatcagaggacaatatgctcaaaattacctcggatggccgtaagctggggcttgaccagaggatcgtcaaccagatgctcccagatgaacccggcacaaaggtcaatcagtgcgtagagaacatcatgcagatctggcgggatggcgaagctgacaagctgacccagctggtgttttgcgacatttctacaccacaggcaaaagctcctgcaagcaaggcggcgaaaacactggataatccactgcttcacgcattggaaggcgctgtgcctctgccggagcaggaaccggcatttacggtatatgacgatattcgtcagaaactcattgtccaggggatgcctgccgaccagatcgcttttatccatgaagccaataccgaagtgcggaaaaaggagctgttctccaaagttcgtaccggtcaggtgcgtgtacttatgggcagcactgccaagatgggcgcaggcaccaatgtgcaggaccgtctggtggcacttcatgatctggattgtccgtggagacccggagacctcgcccagcgcaagggccgtatcgagcgccaaggcaaccagaatccccttgtccatgtgtaccgctatgtgaccgaaggaacctttgacgcatacctctggcagacggtggagaataagcagaaattcatttcccagatcatgacttctaaatcgccggtgcgctcctgcgatgatgtggatgaaaccgccctcagttttgccgagatcaaggctctgtgcgccggagacccccgtatcaaagagcgtatggatttggatgtggaagtatcccgcctgaagctgatgaaagccgaccaccagagcaagcagtatcgtctggaggaccagctgctcaaatacttcccggaggagattgaaaagcacaagggctttatcaagggctttgaatctgatctggaggttttggcagctcacccgcacccggaggacggctttgccggtatggagatccgtggagatctgctgaccgataaggagaacgccggtgctgcccttttggatgcctgcaaggaggtcaaaacctccgatccggtacagatcggcagctaccggggctatgccatgtccgtggaattttccgcttggaaacaggaatatacgctcctgttgaaaggccagatgacccacagggcaacccttggtacagaccctcgcggaaatcttacccgcatcgacaatgccctcgcccagatgccacagcgtctggaggcggcaaaggcccagctggataacctttgtcagcagcaggctgccgcaaaggaggaagttggaaagccattcctttatgaagaagaactgagaagcaaaaacgcccgtctggtggagctggataccctgctcaacatcgacggaaagggaccggcacacgatgaagctgtcgttgccaaaagcacacggccttcggtattggatcatctgaaacgcccggtgccgccccgcagtactgacaagaaaccaaaacaacatgaggaggtgcgataacatgaataccaacgatttgaatatggccctttatgaaaagatggccgctgagcaggacaaatacagggactggctgaaaagccagcccccggaagaaattctgcaccacacctatgagtacaccatccgtgaggacatcgtgatggcgatggaggaactggagctgaccgatgcccaggcagaggcgcttttggaatctccctcgccgctggcggatgtgtaccgctattttgaaaagctggagaccggccacatggatgtgatccgggacagcattgagaaccgtgccaatgatgtgtgcagagctaaagaggaactgcgaacaacaccggtctatccccactctgccgcctatgcgagagaacatggggagctggagcagtaccgagctttcaacaatgtaaatctccaatgcaaggagtccattgaagcggcggtgcgggaacacttcgacggaatgtatctcagtcacgatgcggcaaagggtgtgatcgagacctatggcatggagcgtgtggctttggttctggccaacaccgtccagcttcaggactgggatgggcgctactcccgacgcaataaggaatgggctaagaccattcccaacgagaaccccgaaaccgtccgttgtggttatgtcctgaacagccaccctgctgtactggatggctttattgatctggtgcgtgaagaacagcagcgtagccgtactcagggagaaaaactgcaaccgtcccgtccctcagtacgggataagctcaaacaggagctgccggcccataagcccgccgcctcaaagaaacgggagccggagcgataactatggcaaagcgtaagcgggatatgcaattaaactttagagtttcagcggaggagcttgctgtgattgagcaaaaaatgtctcagtttggaacctccaaccgtgaagcctatctaagaaaaatggcgctggatgggtatgtagtcaagctggagctgccggagctgaaggagcttgtttccctgatgcgccgaagcagcaacaacttaaaccagctgacccgtaaagtgcatgagactgggcgggtttatgatgctgacttggaggatatatcccagcggcaggaacagttatgggagggcgtaaaggaaatccttacccagctttccaaacttttataacggggatagatactccatttgcggagggaggaacggcattacttcgctgctcctctctccgctttttctttttatcggtatccttgtcttttgcctgcccatgccggataatatgattagaaaagataccaagaacgctgcaaggaggaaatgacatgaagattttgaaagggcttttgatgattataactgcaccggtcattttggttctgacactttttgtctggctctgcacagggctgatctacatatccggtctggtgctcggcctgttcagtaccgtgattgctctgcttggtgtggctgtgctgcttacctattccccgcagaatggtgtgattttgctggttatggcatttttgattagccctatggggctgccgttggctgcaatctggctgatgggtaaggtgcagagtttgaaatttgcaattcaggagttggtttatggataaaaatacgcaaaaccataaaaatgccagacaccgtctgttaaatttggaaagagaaactatatatccacgactttacttttgaactaatatcgcgtataatattagtgcgaaaggaagtgatatgatgggacaatttgaacagctggatcagatgctaacagaacaagaaggaatgctgcgaacatcgcaggtcgtatcttctggaatttcaaagccggtattttatgattatgtgcgttcacgagatttggatagagtcgcacatgggatttatctgtccaaagattcctgggtggatgccatgtatctgcttcatttgcgatttgaacaagcagtattttcacatgaaacagctttattttttcacgatctgacagatcgtgaaccaatagaatatacagttacggtcaaaactggatgcaatccaagcaaaatgaaagcagaaggcattcaagtttttacgattaaagcagacttacatgatgtaggacttacaacagcgaaaactccgttcgggcatactgtgccggtttatgatatggagcgaacaatctgtgatttgctcagaagccgtagcagaattgaaattcagacctttcagggagcactgaaagcgtatgcccgtagaaaagataagaacctgcgagctttaatgcaatatgctgggatgttcaaggtggaaaaaattttacgacagtatttggaggtacttttatgataaaaacagcaagacagcttaaagatttaatacgaaacctttccagagaaaaatccgcagatgctcagattttaatgaggaactacatgatggagcgttttttggagcgtatttctctttctgagtatcgtgataagtttatcttgaagggtggtatgttggtagcggctatggttggattggatgcccgctctacgatggatttggatgcaaccataaaaggagctaatgttaatgtggaggatattgagaatctaatttcatcaatcgtaactgttccgattgatgatggtgttaaatttcagctgaaaagtatttcggagattatggatgaagcagagtatccggggattcgtgtcagcatgagtacaacattcgatggtgtagtgacccctttgaaaattgatatttctacgggagatgcaatcactccaagagaggttcggtattcattcaaacttatgctggaagatcgctccattgatatttgggcttataatttagaaactgtgctggcagaaaaactggaaaccattattactagaaccacaaccaatacccgcatgagagatttctacgatatttacattttagaacagctgcatggaaccacgctgaacccgaaaattttacatgatgcgcttctggcaactgctcataaacggggatcggagaagtatcttaaccaggctgaagaagtttttgacgaagtggaaaatgattcggttatgcaaaaactttgggaggcataccgtaaaaagttttcttatgcttctgatttggaatgggatgtgattatgaaagcaattcgcaggttatatgttctttgtgagaagggcatcagcttatgaaaaagcatggacactattgtaaagtttgtggtgaatacaaagccaacaaaaatttttcaggcaaaggtcatgcatcccacatttgtaaatcctgtgcttcgctaccagcagaaaagcaggctgaactgatgacactgaatcgtcttttgaatcttccatggaggctatcgaaagagcagttgtcctggctgaaaaatcgactaaagaataggcggcctgatgtccgtgcattggcgcaagagcaatatgaaatgagatttccaccaagacacttagaagatgatgagttcaattttttcgatgaagaaagttttatagaatagtgaaagcggtctgctatggcaggccgttttcttttcgggaaggaggtctgacctatggcaaccacaagaatcatgccgcttcatgtcggcaagggccgcacagaaagtcgggcgatcagtgacatcatcgactatgtggccaatcccaaaaaaacagataatggcaggctcattaccggctatgcgtgtgacagcaggactgcggatgcagagttccttctggcaaagcggcagtaccttgccgcgaccggacgagtgcgaggtgcggatgatgtgatcgcctatcatgtgcgccagtcgttccgccccggtgagatcacaccggaggaagccaatcggctgggtgtggaatttgccaagcgattcaccaagggcaatcatgcctttgtggtctgcacccacatagacaagtcgcacattcacaatcacattatctggtcatcggtcagcttagaatatgaccggaaattccgaaacttttggggcagcaccaaggcagtccgacagttaagtgacaccatctgcgtcgaaaacggactatccattgtggagaatccgaaacctcacggaaagagctataacaagtggctgggcgatcaggcaaagccctctcaccgagagctgctgcgtgtagcgattgacaacgcattatcacaaagtcctgctaattttgaggaactgctgaagctgctaaaagagtccggctgtgaagtatcaaagcgcggaaaatcgtatcgtttgaaactccccggctgggagaaagccgcccgaatggacagcctgggcgaaggatatggattagatgatttgcaggcggttctctccgggaagaaagcgcataccccacgaaagaaaatagttacacaggcagagacgcagaaggtcaatctgctggtggacattcaggcaaaattgcaggctggaaaaggtgctggctatgctcgatgggccaaggtgttcaacctcaagcagatggcgcagaccatgaattacttgtcagagaataacctgctggagtatgcggttttggaagaaaaggctgcggctgccacggcacatcacaatgagctttcggcgcagatcaaagcggctgaaaagcgcatggcagagattgctgttctgcgtactcacattgtaaattatgccaagacccgtgaggtctatgtggcataccgcaaggcaggctactctaagaaattccgggaggaacatgaggaagaaattctgctccaccaggctgctaagaatgcctttgatgagatgggcgtcaagaagctgcccaaggtcaaagagttacagacggagtacgcgaaattgctggaagaaaagaaaaagacctatgccgagtaccggcgttcccgtgaggaaatgcgggagcttttaacggcaaaggccaatgtggatcgagtgctgaaaatggaggtagaacaggatgttgaaaaagaaaaagaccacggccagcgataagctggtcctggtcaaaagcgttcgtagaacgcgcagccacagaatgaaattctgtgttcaaaggggcttgggggcactgccctcaacaagcagtttgtggcgaaatggatagccacaagcattgcttgccacaatatgctgcgcataaaatgaaaaactaacgacgggacgcttactgcctcctatcgttagttttctgtgtttaagcgacttataaaaccaatcagcataatcaaatcgtcatctgacatctttctcattccgtccaaagccttcttgataagctgagggttattttcctgtgcatcaaaaaattgaagcggtgtgatttcaaaatactcacagatgttgaggaactgcttcatagacggcatagaacgcccagaggaaatcgcctgaatatagcttctgttctgccctaactccatgctcatctgatattctgaaacaccttttttcaatcgcaattctgtgatccgattgcggataaattcttcgtccatacgctcacctctctgctcttttagcatagcagaaagcaattcttgatacttcgtatgtattgtgttataattttataatacaacctttatacgcattattatttgcgttatttttgctttatatgcgtaatcaaggcagttatcaagggtgatttatatgaatcagtatgcctgcgccattaccggccaccgaccaacaagattttgctttggatataatgaggaagatcccctatgccaaaaattaaaagaatgtctcctggagcagtttcggatacttcatgacgagaaatttgtccgtactttttttgtcggcggtgctcttggtgtggatatgtgggctggagaacagctgctgacattgagggcacaaacgggatacgaagatattaaaattgtcgttgtagttcccttcatcggttatgactctaaatggccggatcagagtagacatagattgaaaaagctgatccaaaacgcaaacgattccattgttatttcacattctgcggatgtttccagttataaaaaaaggaattactatatggtcgatcatgcagagtaccttatcggtgtgtttgataatcagaaaaagctgcgctcaggtacatcacagacagtcaactatgccttgcatcagggaaaagtaatcactctgatccatccagacactatggagataacagcccctgcgccttaacaaattcacaaaaatttttcattagcatttccaacaaaatattttcattgaaggggtgctgtgatataataagatataaaactacgctcagaacaaatggtgccgctatgaacaaatatattggacagcaatttgctgctttaagatacgaaaaaaatattttggttgttgaagaaactacatctgctggtggatgcggctccttcaacgcggcttcttcatgtcctgcgtcagcctgtctttatgacagtgcggcgtggggcttttttattgtttgaaaagagtatgaaaagagaaataccagcaggtatttgcgtgaggaggaagtagaatgaacagtgaacagatcacagcatttttgcaagagcattggtacattgcctcggtgctcatcggggccgtgattttaattggggcgatccgcaactggaactggctctgcgaccccactggtacgcgggatgcccaccgccacagcagaggataccggcgggtggtgttcttcctgctgggcgtccttttgatcgtggtgagcatctggggatttgtgctgaaattgaaataagaggtatatctatgaaactgaattgtaaacgcattgattttacatatacacccggtgaggaaatcttcaactttcccgaggaatcgggactaccctttatcttcgatgtagaggaagaactgaccggcgatcctgctgtcatggatgcggtgggagaaatgctggatgaggcggagaaattggcggagaaggccaaagccgccatcaaagcggcgctggcagacgaggacagccgctaccatagcgttgtgacatttttcatggagttccatcgggacgatgtaggcccggatattgtggcggaactttttccgggaaccgacccagccaaactgtcctttgctgagatggttgactttttgaagctcaagcggttcggcagtctggtggatagcgagatgaaccagcaagttttcattctggatctgtcctttaacccggagattaccgacgaactgatggtaatctactttgatttgaacaaggagattttctgtatcacacatgagagctgagcgtgactgacatacacgaggaaaggagcaatccctatgaaagcatttgaccccaattacaagctgctggacgagatgtatcaggacgattactatcctgcttttctggtggacaaggtaaaggacgagcttcagaaggtcatcgccctgctggagagtggcgaaaccgacaccgaagtggtgcaggaaacgctggacgaggcggtctgcggcatcaatgatctccaggaggagtttgacgagaacgacagcgagatcgaaacggtggcgcgggaatgtattgcggcaaccgtggcctacattctggagtggtttggcatccccattgacaccgaggaggccatccgggaacgggactggtgaaccctatggcagaaaaagaactggccctttgtgatgagtgcggaagcctgtttttcaaaggctcctcacagatgatggggctgtgccagaatgtgcccatgttctctatggctacccgaattgtgaccatcattttcaggatggccggtgtgtgaactgctattgggacggctcaaagagtgtgtacatcaagaagcagaatcaacaggaggaaactgatatgcctacaactgaatggctgaacaaatacgaagcaatcaaggataaattgacctgtaaagatgacttggaggcccatttcacagagaaagtgattgggaacatggcggtggatgtgctggacatcggcaccgtccatttccccaccgggcagattttcgcctgtgatccgctggtggaactggaggacactctgccgttccttcaaacgatccccgccggaacttatcccgtaaaaatctgcgtggtgcccagcgaacaatacggcgaccgctacgcctgcgtcaaggtagaggtcaaccaggaaaaacctgtccgctatgagctgggcatggtgggcaacgaggatctggacgaggaactgggcgaggacgagtattttggctttggcgtagacgccgggatgggctgcgttgcggacatccagacccaggcggccttcaaggcatactgggccaagcggctggaggaggaccctgacattgacccctataacaacctgttctgcgacttgctggaggaaaacgccaaagctcaccccaaatatcagggggactgcggcgactggctcaactggacagtgccggacacggactgcaacctgcccatctttgcctctggctggggtgacggctactatcccgtctactttgggtatgacgcaaagggcgaagtctgcgccgtgtatgtgcggttcatcgacattgaagccagttatcaagaacaggattaaaaatgtgacagaacaaaggagaacactatgaaagacctttgccaatacggaaaccgaccggaggacgaatgggaaatcttgccctggatacctgacccgcgcccgcccttcaaaatttgggtgaagctggagcagatcgcgccattctttctcattccccaccacccctatgcaatctcccttctgctgaaaatcagcgatgggtttcgggcagaagaattctgccggctgggactgaccggcagcagcggagactgggaacggctggtccggggcgtgatccgggagtttgaggaaaataacagcggcgtggatctgtttcacttcgactccgacgaagatgtgttctgcgtgtactcccaatacatcgacgatttgatgctactgtccaaaatgatccgggcggcctgtgacaatgaaaaaacgatggggacttatctgggtataggtgaggtggaagatgagaaataaggagcaggagatggcatggcgaaaagtaatagaagcctgcatggaggatgtgaaacaccacttcgatgacatccagcaggccattgagtttggctgctacatccagccggacaactactttgtgtcctacatctttgccacggactcgcaattagagacggcgcggcagagcggcctgacggaacagatcaattcctatcacagagagcagctgataaagagtcattaccccattgagggaatcaaggactgcacctttgcctcacaggaggaatgtgaccgggaatttggcgggaattggtattactatttcaaatgatacgatgaagggatcgagatgatcgagtacatcaagctcttttgggcgggcgcaccagagggtgaaccatcggtcatcctctatgaagtggataccgaaaatgagcggctggccctccgctccattgacatctttgcggatggccgcacccgcaacatccctgacctttacgacggtgtcatcgagatcacgccgatccccaccgtggaggaattgaacgcccatgtctggggcgaggaattccacgcctgcatcatagagcaggcggaatttgaggccatctgggaaactcacacctatgatggagcgttaaagtagccaggaggagacactatgaacaaacctataaaagccaaaaatctgccgttgttctccatcattgacctgaaccagctgcgccgggaaaaccatctggagggcacagaagtgacagactttttcacggaaagggatggaaaagtctatcttctcatggaacagccgtccgaaacacagggtaaggactggctcagcactccttccacctataccgcagtggaaatccagctggattgggcggaacagcgggtgctggaaacgacgctgtttcctcttggcctcttgaagttccagttccattatttgcggcccgcaggtgaccacttcctcctgctgggggcaagatgcgcctatcgggaaaacggccccgaccagaacgcctggatcgtcagccgggacggagctgtgctgtcccgtttctgcctgggggatggcattcaagactgtgtggtaaaaaaagatggcaccatcattaccagctactttgacgaaggtgtatttggtaattacggttgggatgaacctctgggtgcttgcggtctgattgcatggacatcggagggaactcctctctggaagaatgagaactattccatctatgactgctacgccatcagcctggacgaagaagaaaacctgtggttttattattacgatgaattccggctggtgcggacgaacttcaaagaggactttgtatttgaactgccaatcgaaggaagcggagctttttctgttgccccgtccggcaataccttcctgtttcaaggcggataccagcaacgggataaattctacttccttaccgctcatggtgatcaccttgggaaaaaacaggaggctattcccacctgtgacggaaacaaggtcgctgtggagcagtgcagcctgcttcgcagccggatgttgttccttggaaaagatggtgtgctctatggaggtatttgggggagcgatggccaatgaaacagtctgatatttataccgaggctctgacctgtctgcgctccatccttctggcagaccatccagagttccaaaactggatcgactggttggagcgggacattcaggactggaaccagcggcgggaggttgcccaccatcttcgggcatacggaggtatgggctcgttcaacgacctgcccagtatgcgtggaaatcacgactatattttcgactttctcaagtccgtgtgctatgccttcggccatctttatggcaaacgggaaggcatttctccggaggcattgatggaggagtgcctgcacgatgtagagcaggcagcctatcacccccataaggcactgaaccaagccattgcccagcacttgatgcagggcgatttacaggaaaacctggataggctgtaggaggacttgttatgaacaaaagactattccgcacccaattcaatcaaatggaaaacatcgagaagcaggtgctgatggagagcctggctgcccgttatgatatgacctttctcggtctacatacttttgaccgctggggccagagctgcaccaccggcatcttcaagaaagatggtcgggagttcgtctttgtccccggcgataccgtcaccctgggctgggagcagtttgccgtgggactgaatcaggagagctgggaggaattggagtatctgttccgggaatgggaaatggagcgggacccggaggagatgattcgggaaagcatggctcctgttcggcaggtggccattggacccatgctggtgggccgggagctggaggaaattaactgggagccagtcaaactggaggacccacgactgcgctcggaatggttggaagattttcgccaattcgctttgaccgacagggacagtcttactctggcaggtcgtgcccgtttcgaacgggatagtgacagctggcaggtcagcctctatcacgaggtggactatctggactttcaaaaccggctgcaaaaacagggcttctccctgcccacggcggacgagtgggcctacttgtgtggcggcgagtgccggaccctgttcccatggggagatgggttagactactccatgcgtctgcgctggtttgaggatatggatgaggatgagaaccggccttatgacatggaggaacccaacttcttcggcctgtctatcgcctacgatccctatatgcgggaagtggtgcaggctgatagacttaccacctgcggcggtgacggcgggtgcaatatctgcggcgggctgggcccatttctcggtttcctaccctgttcgccccactgtaagccggaagtgcaggaggacaaggaactaaacggagattatgacttctaccggcccattatccgggtggagaaccatgattgacaatagaagcttgatacgaaataaagaaagagaggtgccgacatgggagcatggggtataaaagcattagagcgtgacgaagggctggatgtactggacatcctcaaaaatgaatatgtaccggagcatccggtaatggatctgggcgagatgattgaactgatgaaagaggaagtcatgctgggatctgacttctcacaaatcgactttctctttgacaatactgcgatggctctggcggagctgtattttcaatggaaggataacggcaagctggactacgatcatgaagaagctatatgggataaagtcaccggtttcacagcatccaaagaagcacttgctttcctgctgcggcagctcaccgacatcaaaaacgaggtgccggacgaggacggcatccgtgagattatggatctttggaagaacgaggatagcggtgagatcgctcctgcgtggttggaacacttgaatcagctcattgatcgactggattcagaacaggaggcacgacaaatgtatatcaaaaaatactggggcaactttattggcggttccgatgacagtctgaaccttgtggcatttttagaggatcagaaaaaggaggagatccccctcagcgagattttcgccaagatcggtctggacaagcagaactgggactttcgccaaaccgtggagtacctggagtttacacattccgatggcgtggaaatggacttccacttcgccattgatgtggtcaccgacctggccgccatcctgctggagtgcagcgtcagtggcagtgtaaaccttcaggatctggacgagtacaacacccccatccgccgtatccgcatcactgctacgccggaggagcacgaggccatggacaaggccctggcggactttgcccaatcccccctgacctatgacctccatgaaatgatggacgacgaggagattcaggagatggcacatcatgtggaggcgctgcggaaggaactgtacgaggccgctggccgcaaccgggactaccatgtgaaagcggaggatgtgaaatctctgctccctgactggaagggtgccgatggctgcatcgccaccaaccgcatcacagtagagggccgcaaggtgggttactgctatcgtgagattccagacggtaactgggacagcggctggcgcttcactgccggtgacgagagcgatgagtacatggacgaccccaacaatgccgggatttacaagctgaacacaatttgcaacgacgatcccgacatcatttctctgctgaacacccccgccccctgcgcctttgagcgggatgagaacggtgtgttccagcagatcaaagactggaaaccggatgaggacgaggaggaccctgatatggacattttgaagcagtgccagaagtggcatgaggagagcaaacaacataaaattattgatgcgctggaggccatccccgccgaggagcgtacccctgagatggacagtgagttagcccgtgcctataacaatctggcagacccacataagccaacttgcaaagaaatgctcaaaaaggccctcgctctgctaaagccccatgaggaatacttcgaggacgattattactggaacttccgcatgggttactcctacttttatctggatcaggagggccgggctctgcgatattttgaaaaggcattggaagtccgccctggtgacgatgacaccaaagagtttatcgaccggtgcaagcagggtatttctctgccgcagttctgggagtgcttccgagagcggacagagaactggtgggaaacctttgccgagatggaagcagaattgcgccagatgatggatgaggacaaagatcatacccgcggcgcagaactcgtggcccaaatggaggacaccctgaatctggtttttgatgaaatttccttcgagctgggcttcaatggcgaaaagcatgagctgatcctcaccccggagggtaataaggtcaagctgtttgagctggtctacttccagaaacacgccccaaaggaggtgctggagcactggaacatccttgtgggccgtcagccctcccagaatatcggcctgcgtaccgacgacagctgggacatctccggtgaggatgtgcagatctggctggaggaacagggcgaaaacagtttcaacatctccgcctactgtgaaaagctgctgcctatgctccgggaggcggaaggccgagtctggtggatgctcaccaccctcaccgatcagatactgggcgagatcccccacatgagatacatagacagttttgatgtgctggaggaacccaaggcagagccgtccttcctcctgtcccagctgcccgacaaactgcgggagcagggcctggagctctccaccgatccggaggcctatctggagagctatcttggctacgaaatgaaacccaatgaagaccccaacgccgattggcggctggatgtaatggccggttccacctgctgtgtgccgctcatcaacggctatctgaatgccgacaacgactttatggacgatctccatgccgacggagcggtagcgggctttttctgctatcccctggataccttgcgggaggaggaaggatcggaaaagattttcgacttccgggacaagctggaggaattgttcaccaccgtggacggatcggagatgctcgccctcatcggcggggccaccggcctctactgtggctatgtggacttcatcgcctgggacatccgagaggcgctgaacatggcgaaagagttctttgaaggcacggatatcccatgggccatcttccacaccttccgccgtgaagccggttctgtacctctaaagcaacaagatgatgggacagaaactgaaaatcaggatgacgagttggatgaaacgcttacgggcatggactatattccttatacccaacaggacgccgaagcattcttcgctcagctggagcagtggaacgacgaggacgagtacacccgctgcatccaggcactcaatgccatcccagaggactggaggaactatcgcaccgcctacgccctggcacgggcgctggagaactacgccatcatcggggaccatgatgagggtactttgaaattcaagagagacaaagccctccagagggccattgaggtgctggagtccgtccgggaggaaggtcaggacaaggcggagtggaatatgcggatggcctacggctatcagtatctctatggtcaggaggaaaaggccattccctacgcccagcggtgggcagagctggacccggaggatgaaaatgccccggcggtaattcgggagtgtaaggcggagatccggaaacgccagcgcagccggaagaagaaggccaaattcgtgcccggtgataccccatttgagggtttcgacctcaccaacttctgggatgataattggtatgcactgaaagaatatgtcagtgatccgccttccgatgagctgattgccagcgtggaggaggaactgggctacaagctgcccgccgcctacatctggctgatgaagcagcacaacggcggcattccggtgaacacctgctatccctgcgatgagcctacctgttggtcagatgatcatgtggccatcaccggcattttcggaatcggacgggaaaagagctgctccctctgtggagaaatagtagcctctgccatattacactcttttgccagcgatgatatggaaagaaactgtgcctcctccgcgtgtctggtgaggtagtcagcaataatcgtgccggactttgtcagggtgccctgtttttcccgtaacaaatcccagaagttcttgtttaccatagtaaataccctttttgaaatactttctctttttattttgaaaaattccttctatttatatagaaagaataaatcaaaatgacagtgtttgcaagcagaatctatatttgcgaaaatatttttcacgccaataaaatccaggaaagcacatgactttgcaaatccttttccccgatttcaactacttgtttggtatcgaacattttttcttcattactttgtgcaactctaacaaatttttatttaaaaacatatacactactgccatagacaagatgaaaaatattttctaaaatgaaattactctaacaaatacttgataaaaaggagagagaatatgaaaaagaaagtaattgcagctttactgacaagtgcaatggctgtcagcttactggcaggctgtggcacaactgtagaaagcaccggaagcagccagtctacttccaccactgaaactaaagaaaccgcagctcccgctgagaccgagactgctgctgttgagactgaagttgctgaggaagacaacaccgatctttccgctaacattaccttatggacttatcctattggtaaatggggcgattccgcaactgttgattccctgatcaccagtttcaatgcaaaatatcccaacatcaacgtaaccgttgagtatctggactacaccaacggtgatgaccaggtcaacaccgcaatcgaaggtgggcaggctcccgaccttgtaatggaaggacctgagcgtctggttgctaactggggtgctaagggactgatggttgacttatccgacattatggatgacgaagaccagtccgagatttacggctccgtattagctgcctgcatgacaaaagagggtgcggtttatgagtatcctctgtgtatgaccgctcactgtatggcaatcaacaaaactgtatttgaggctgccggcgcaatgcagtatgttgatgaagattcccatacatggacaaccgaagatttctttaaggcaatcgatgctgtttacgctcataccggttctactgtaggtgctgtttactgtagtggacagggtggtgaccagggtacaagagctctgattaacaacctgtacggcggtacctttaccgatgatttacacaccaaatataccgctgattccgcagagaacgtaaaagcaatccaggcactggctgataccgatggaaaaatcgctttcgatgcctccatcgccggtggtgatgaaatcaacctgttccgtcagggcgttttaaatgtagctttctgctggaacattgcacagcagttaaactccgataacaacgatgccggtctgaccaacaacggcgacgaaatcgtattcatggctttccccgctgagaaggctgatgctacacagctctgtggtggtatctggggctttggtgtattcgataacggcgatgccgatagaatcgcagcatccaaactgttcatcaaatacatggctgacagcgcagatggaaccgctgatgcagttctgtcctccacctacttccctgtacgtgacaccgttgaaggcacagatttaaccggtctttacaacgatgttcctaccatgcaggagtacagcaaactgatgcagttccttggtgactactatcaggtaactcccggctggaccgaggctcgtaccgcatggtggaatatgcttcagcaggttggcagcggcgcagatgttcagactgcagttgatgagttcgtttctactgcaaacgcagcagcagcagctcaataagtctacaactagttgaaccctataactataccagaaaaccctcctcaggatttccggaggagggttttcttatcaaaaaaagtaactgaaaggatggtgctttccgtgaaatcagcagtgaaaccatcaaaacgcagccgtgtattagtgcgtaaggagacgactgccgcatacctttttctgctccccagcttaatcttcttcctgggattcgttatctaccccatcgttttatgcgtgtggaccagcttctttgactccactatgaacgccaaagatgtatttgttggatttgccaactataaagagttattccaagacaaagttttcctcggagcgttgaaaaacaccttcattattgttgtcgtttccgttccgattaccggtgctttttccctgtgggtatcttctattattgtagatttaaagggatgggcaacttctttattccgaatcatcttctatcttcctgttgtaaccggttccgtagccgttaccgttgtatggaagtggatgtttaacaactactacggaattttcaattacttagggactactaccggtcttatcgaaaagaacattaactggctgggtgacgagcgttatgcccttgcctgcatcattatcatcctgcttaccacttccgtaggtcagcccattgtcttatatgtatctgccctcggcaacgtggacgcatctctggtcgaggctgccaatgtagacggcgccaccagatttcaggctttctggaaagttaaatggccgcagattatgccgaccactttatatattctcgttattactaccattaacagtttccagtgtttcgcactgattcagctgctgacatccggcggaccgaatcacagcaccgacactatcatgtactacatttactattctgcatttaaactgtaccgttacggttacggcgatgcaatgggcgttgttcttgccatcatgattgctatcctttccgctatacagtttaaactcggaaacagcaacgattagaaggaggagagaaaatgaaaaaagagaaaaaattaaatcatccttctgtctatagaattatcagtattatcatcattgccattttagcggttttatttaccttcccgttatactggattattacaggttcctttaaaaccaacgcagctatcaactctactaccccgatttggtggccccaggagtggactctggcaaactaccagaagctgttcagccgtcagactgcaccgctgttccagtttaccatccccttcagcagcctgtttaccggcagcagcgacttgaaactgattgtatccggtccctccgtgcccgctgcaatccgttggttaatcaacactgtggtaatggctgtactgtccatgattcttacctgtatcactgcttccatggctggatacgctctggcaaagaaaagattcgtaggacgtcagttcctgttcaccatgattgtatgtgcaatggctttaccgaaacaggttatcttagtccccctgctgcgtgaaatgtccaatttagatctgtacaataccatctgggcagttgtattccccatcgttggctggcctttcggtgtgtttctgatgaaacagttctccgagggtgttccttccgagatgattgaggcagcatccattgatggtgcaagtgaggcaaagacctttgtccgaatcattgtacctatgattaagcccggtatcggtgcgctggctatctttaccttcatcaacagctggaacgattacttcatgcagttaattatgttatccagcacaagcaacctgaccatctcccttggtatcgcgaagttacaggcagagaacgctacggacttcggtctgattatggcaggtgctgctctggccgctgtacctatcatcatcgtattcctgattttccagaaatactttacaaagggtattgcaatgggagctgtaaagggttaattatttctatatagaaggatatgcgccgttgaaggcgtggaaatgaggcaaaataaatgaaagacattacaaagtatcaaggcgtcatcccggcattttatgcctgctatgacaaagatggaaatatttctgtagaaggtgtaaaggctttaacccgccatctgatttccaaaggtgtgaagggtgtgtatgtgggcggttcttccggcgagtgcatttaccagcacgtggatgagcgcaaaaaagtcctggaagctgttatggaggaggcaaagggaaagcttaccgtcattgctcatgtaggctgtaacaacaccgcagacagcgtggagctggctgcccatgcccagagcgttggtgctgatgccatcgcatccatccctcccatttacttccacttaccggaatatgccatcgcagaatattggaacgctatgagtgctgctgcacctgatctggatttcgttatttataacattcctcagctggcaggcaccgctttatccatgaatttattaaaagaaatgctgaaaaaccccaacgttatcgctgttaagaactcttccatgcccactcaggatatccagctgttcaaggcagagggtgtacatcagcgtggcgaaaatggattcgtagtgttcaacggccccgatgagcagtttgtttccggacgcgctatcggtgctgacggcggaatcggtggaacctatgcggttatgccggagctgttcgtaaccatggataagctgattcgtgagaacaattttgcggatgccatgaaaatccagtacaaggctgatgctatcatctacaaaatgtgcgaggcaaagggtaatctgtatgccgtaatgaaggaaatcctccacagaatgtacggtctggagcttggcagcgtaagacttcctctcgctcctctggcaccggaggatgaggctgttgttgtagaggcacagaaaatgattgaggcagcgatcgctgaactttaatccgaggaaatactatgattgcagattctatcaaacacataaccctctatcgcgggatgcagccctatctggacacagcgattgactttttgctgaaaacagatttaagcacactccccgatggaaaaaccgtgattgacggcgaccacgttttcgtcaatgtcatggaggcagatttgcgtgaggcagagggtgccacctttgaatatcacaaaaaatatgcagacttacagattaacataaccggaggtgaatattgggaatgtactctttccggtgaaaccgcagaggaatacagtgaggaaagggattgcggtcttatgaccggaactcccacctgtaccggaactctgggcaatggaaggtttactgtctttttccccatggaataccacaagcccagttgtatcaacggagactgtacccatgtacggaaagcggtcattaaaattgaagtttcctaaaatccctcataaactttttatttcgtagggaaaatttcctatgaaataaggaaaatcccaaggcagaaaaccttgggatttctccaattataattacgattcagagccaggcagatttgtcttctgtaaatgctggcatttagacagaagggcagatttatatggcgtatggtgtctggatagttattccattatttaaaaagaaaggcaggactacattatggacaaagaggcaatatttaaacagattaagggaggactcatcgtctcctgtcaggcactggagcatgagcctttgtatacaaaagaaggcggcgttatgcctttgatggcaaaagcggctgcacagtccggcgcagtgggcatccgcgccaacactgtccgggatattacccagattaaagaggcagttgaccttcccgttatcggtatcatcaaaaaggattacgagggaactcccatgtacatcacggttaccatgaaagaggtagatgagctggtggcatgtggcgtggatatcctggcagttcagggaaccagcgcactgcgtcccgacggcagcacggctccccagtttatcgcagccattaaagagaagtatcctgaccagcttgtgatggcagactgcgctaccctggaagagggtatcgcctgtgccggggctggggctgatttcgtaggcaccaccatgcggggttacactcccgaaaccaagggcattgacgatatcgactttgattttatccatgagctttccgaaaaatgtcctgcaaagattatcgcagagggacacatccactacccggagcaggcaaagaaggctttagaggctggtgcctttgcactggttgtgggcggcgctattaccagacccgctgagattaccgcaagatttgtctccgcaatccagaaataaaggagtaacttcttatgaaaattgtcgcagtggatattggcggtactgccatcaaagcaggtctttgggacggaacagaactgaccgacatgaaagaatgggacaccgaggcatcccagggcggtgcccatctgatggagcgggtaatgcagctcctccacacttattccggttttgatgccatcggtatcagcaccgccggagaagtgaacactaacaatggcacgattttttatgccaacagcaatattcccggttataccggcatgccggtacgggacattataaaaaatgaattccatgtccccgtggcagtggaaaatgatgtaaactccgctgctctgggtgaactccattccggagcaggcgtgggctatccggattttctctgcctcacctacggaaccggcgtgggaggctgtatcatcatcaacggacaggtttactccggtgcatccttctctgccggcagcttcggcggcattgtgattcacccggaagtcaagaatggcacggataccctggagggctgttacgagcgctgcgcctccaccaccgcactggtgaaacgggcaaaggctgtggacgaaaccctggacaacggcagaaagatttttgacgccatggagcgccctgaaatcaaagccgtgattgacgactggattggggacatctgcaccggtctggttaccttaaccagcgtctttaacccttcccgcatcattctgggaggcggtgtcatggcacaaagttacgtgcttgcccagataaaaagccgggtaaaggcacagctttccccgggactttcccatgtggaaatcgttcctgcaaagctgggaaataccgcaggtctgatgggtgctgtcagtctggctgagaaattattagacaaggagaagtaagcagattgaaaaataaaatttttcaatcgcgagtttgtgtctgtgcgcacttgacacaaactcgttatgcgcagaaaacgtgcgcagaaatgtggaaaaacatgcagaagaatattttatgtttcggagattccaatactcatggatataattccaaaaccggcggtcgtttcgatgtgaacgagcgttggaccaagcttttacagaaaaatctgggggatgattactatatcattgaagaaggactcagcggaagaaccacttcctttgaggatccggttttcgagggactgtgtggcttaaatgtcatctatccctgcatgatgtcccatgagcctctggatttagtcattatcatgctgggcaccaatgataccaaggatcgctttaatgccaattcctttatcatcgggaaaggtctggagcgtctggcacagaaaaccattgacacccacgctgcctggagaggcgcgcctaatgtgctgttgattgctccgcctcccatccatcccgattatgccaaaaccgcggttgccggtgagatgggagacaaatgcgtagagcgttcccggggtctggcaaaggagtttaaggatgtggcagaccgtctgcattgccattttctggatgcaggctccattcccggcattgagatgtacccctacgactggatgcacttgagcctggaaagtcacaaacttctggcagacgagctgacaaaagtaatgaaagagatactctagggattttgttgtatacaaaagccagtgggtgttttgcccactggcttttgtcatggttttaaaacccttctttccgtctcatcagccgcagttcccggcgtttgagtgcgttgtcccactccatctgctctgccgggtcgtcggggtttagcagaaggggcggcgcttccgtgggcttgccgtcctctcccatgttgaccatgacgaaatacgcacggttaatgggatgacgggtgccgtccgggttctctttataagtgtcaacccgtacctccatggaggttttccccacataggttacccgcccggtaagtaccagcacatcgttgataaaggcacctgccttaaactgcagattatcgatggctgcggtggtagcattattcccacagtggcgtctggcggtagcacctgccacttcatcaatccactttaacagttgtcctccaaacagccgtccgaatccgttaatgtccggataaattactacatgaatctgttccgtcagagagtctgtcacttttttcggttccatttattttccccgctttctttgctttcttttgcttaaatctctattcccatcataccaccccggtcaatgcccggttttgaactatagcacatgctgctccaggcggcgcagtgcctcctctacccggcttttgggcagataatcatctgctccggctaaagcctgcaatgcggtcatccgtctgtccttttgcggtaagcatcataatgggaacctggacgccttccttgcggagccgctgtaacacctcgatgccgttcattttgggcatcatcacattcagaatgatggcatcatagcccccggaaagggcatagtcgtaggcgtcctgtccgttgtgtaccgcagccacactgaactggtttttttcaaaaaagacggtaagcgcctccggaaaatctaatgagattttccacgattctttccttatagtataggaggaaacgcggaagaaatcaatatttgcaaattttttcctgtctttaggcaggctttaggatggggcgctacaatacgtttgacaacagaaaaacaacagactttggaaaggagaaaacttatgaaaaaatcactttgtattttatgttccaccgcaaccgcgttatctctgtctgcctgcggaactgcacaggtttactccagcgaggctgcggagacaaccactgtttctaccgaagaattgaccaccgttaccggaaaggtaacagaaattggggcgccagcgtcacactggcactgggagaggtttcggaaaattctgatgggaacaccgcaccggacaacagcaataattccgacagtactccggagatgcccagtggcagcgctcctgatggaaacggcggttttgggggcagcagcgaggtaacccagggtgacagtgccaacaccatcaccgaggatggcacttacaccggcaccacctacacctccaccggggatgatgaaaacgctctccgggtggatggagcaaccgtcaccattaaaaacgcaaccttgaccgccaacaattctgaggcgctggttatcgagggacaaaactccatcgcactggaaaactgcgatgtcattggaaacatgagcgacaccaaaggctccagtggaagtaacggcgcacaggtggaatttaccgcagacagccagaccatcaatggagacatcatcgtggacaacatttccactctggatttctccttaaccaatggcattgtcctcaacggcaccatcaattttaacggctacaccatcacccttgctgatggtacggttctgaaataaatataggtcaacagaagaagagcccttccacggctatagggaaaggctctttctctttatcaatctctgaaacactttgagtttacataattttcatttttacccataaacatgattgaattcataccttataggtggttttttagagctttcatagtagtccaacccataagcagcaccaaatcaagttcttatatgtctgatttcaagaaaatttgacattttccagcttacaaggcttacaaaagacccataaaggattacaaaaagtatattctatgggttgatatcccgcacgcagtgctttcagaagcctataggaatcacagtaaatccgctcttatgggttagaggcttgcatgcctttctcccggtaacccatagacagcaacgcaaatttctccttataggttgccagtcagtacacgccgtcattttttactgcctccactcctcaaggactttgcttatccggcggtcaatgtcctctctggtggttttgcactcttttggatattctctggcggcatgtaaagcaagtttcacaaaaagtccggagccgatgggcagcatggtctttatcatgctctccaggaaaacaaaatgggttccgtgctggtaggtcaaggcctccacttcgcagacgtgagtctttgcgctaatcggtttttcatgcggcgaacatattttgcagcataccatagcccgtcatcctctgcaccgatggcaagcagttttcccttgatgttttccactggaatcatttcttcctcctgtaggggatgtgccgcctcggagtcatcgaaaagttttctggaattcagcatgtccccagcgcgtttcgattccgcctgaaccacttgccaatacttaggatgctggtacacaaagggcatatagggcaggggcttgcccaggtaagaaaacagggactctccctcgatgggccactctttacagccgtccttttctccctgcataaagccctgccagataaaatcactgggagtcatggcaatggtgagggtaatgtccgggaagtaagctgccgctgtcaacgccagggttccggtggtggaggctccgtaaaatccctctgtttccacatcaaaatgaatccgtttcatgttccgttacctcgtatagtctcaagttaccaagattagatacatctaactttcatattaccttcattgtaatgcggtaaatttcctctatcaaggagtagaacactcttgcaaaattgagatttttccattaaaataaccgcatatttgtatctgaaacagaaatgtttcacacgactgccaccgggtaggaatgcacagagcattcgctacacatcgttaggtctcagaagatgtgtgcggatgcttttttatgctatgcataccgctggcgcacacaaagatccggcaatggactctttgttcccggaaaaatttaaaggatgttcataaatgatacgagataagcgcacactaccactattggatccttggacttcttctttttgtcataaacaaattaccagataagaaaaaggagtttataatcatgagtaatcccgtaaaagattttacaaagaaagaatggagcctgtggcttggctccctgttgattgttgttgtttccaatttattttccggggatgtggatctgccgaccctggtggcggcactggtgggcgtaacttccctgatttttgccgcaaagggaaatgtgtgggcacagatccttatggtggtgttcagcatcctctacggcatcatctcctggcggttccgctactggggtgagatgatgacctatctgggtatgaccctgcccatggcggtgtggtctaccattacctggctgaaaaatccttcggagacaaacggcagcgaagtggcgatccagcagttgaatcgatgtcacgttttcggtctgtttgtttccggcatcattgtaaccgttattttttgttattttttgtgggttttaaaaacccccaatcttctgttcagcacgatttccattaccaccagctttgtggcggcggcactgaccatgctgcgttcttcctattatgcggtggggtatgctgccaatgacctggtgctgattgtgttgtggtcactggctgccatggagaatccggcgtatattccggtaattgtgaattttgtaattttcttctttaatgatatgtacggctttatcagttggcgcagacgggaggctgttcagggctgacctgttgagaattgcacgttatttttccagaaaggagacagggaaccgttgtctattgccgaagaacatacctatatcgctatcgacctaaaatctttctatgcctccgtggagtgcctggggttagggcttgaccccctggacaccaatcttgtggttgcagacgagatccgcacggacaaaaccatctgtctggcggtgactccttccttaaaagcctatggaatttccggacgtgcccgtctttttgaggtgcggcagaggtagtccatgtggatcaggaaaatgactataaaattacccatctggcagacagctttgaggaatttatccgcggactggagcatgaatccctctatgatccggatgaagatgcagaggatcttgaagatgacgccgacgaggaggaaaccgaccataagggttcctttgccggatctgtgctcctctccaaagcagagtgggacaaggagcagttgattcgagatctgcgggaagaatggggtatcgtagatgaggagccggatgagggcgacgaagatgttgagaacagcgatgacgctgtggtaatgcgggtcggcaatatgatgctgattgtgacactattccacggtcacatcccggacaatgaagcagagatcaacgccgaaaacaactatatgtggccagaggccgtagaagtggccaaagcgcacaaggcccatatcatggtggctgtgttgggcgaggaggaaaaactgctggaacgaggtaagctgttcaccaaggcgatggcagtgtgctgcaagcagaaatacgccaccggtgtctacaccagcggcgtggtatttgagcctcgtttctatgagggccttgccgatatgctcaaaaaggacgaactgcccatcttcaactgggtttggttcggcctgtaccggagcgaggggggcctaaacggctacacctacggcatggatgtgtttggcaaggaggaaatggaggtgttgaacaccgacgctgagccggaggaactacgggactttttggcaagccttgcctcctatgtgctggcgtgtgatgtgacgctgcaagacggcgagaccatcggtttttctgcggacgataagcacaccatcacccgcagccccggtgtctctctgccagaggaacagatgaccctgaagatcggttacgagcctataaagggagatccggaggatgacgatgacagcataggaatggatgatgtttcctatcatattgagaaccttgaggagaaggagcttcccattgaccccatcaacgcctacaaccacatggcgatttatttgcgctggtgcatggagcatgacctgatgggcgggaaattcctggcggagcatggcgaagtggtaaatcaggtcaaagccgatccaggcaacacagacctacgaacattcatccgggaggagctgttcggctgtctattctcggctctgttcaatcagaaaggccgtgcctttgcccattattactatggagaaattgatgcgccctattatcctgccgacattgatgactatgccctgaaatattttggtccgtcccgataccactccaatgaatttcaacaggaggcatacttattcatcccctttgacgaggactactatcaggctatggcagaggtaattgaggaacgcttcaccaactggcagggacaggactttgacgaggatacgctggagccttccgaggtggcgcaggccattatggagtatctggactgtgagtgtacctatttcccgtctatggcagatgatgatcccatcatgtcagcatacagctacgcccggcggctgggggtacgggagggctttgttcccgtacttatccaggcggatgatgaaacgcagttggagtgtctggtgatgaacgctgacccggagcatgatgcggacttctatgaatttgacctcaaaaccgtggaggagtatcgaaagaagatgctctccgctcccatcaaggacggaaaggcgattttggaggaattgaccggtcagcgcaaggaagaagccgaggacgatgatctggactgggatgaggaagtcctgggcgagatggagggcggagaacccaacgaccgcttcgcaaactattggaacgatgataccggaatgacatatccgctcattctggctaaaattccggtaaagaacccctgggagatcttcgcctacctgccctttggaaattggaatgagtgtcccgacacaccggacctgatggcagtggcgaaatactggttcgagcaacatggtgccatccctgccgccatgagccacgatgaattggagtttgaacttccaactccgatttccaaggaaagagctatggaggtggctgtggagcaatatggtttctgcccagatctggatcagaatgaggatggaagcattggctccttggcagctgtcctgtggcagtccaccgtctggtatttctggtgggattgatgggaggtgcgaccaatgacagaatatcaaaaaacctatatcgaactaaaaaaacagtttgttgcgaccaatgaaggtccggacagtgtccgcgctctatataccttcaaggaagaacttgagcagagtgaggatcagcaggccaaggaagtgctggtggatgtgtatgatctactggacttcaagaaggatgcctatgaactgctctgccaaatcggaaatcgttccgataaaaagaccctcaagcggctgggcacgctgaaggactatgcggaaaactggggcaatcattatgctctccccaagcccaaaacgccggaggaaaagcagaaagagaaggaacggcaggcccagctgggcctgcccgccttccggtatcacccaaaccctctggaaactggggcttttgaggaatccgcagacggcgttgtctgcgactgctgtggcaagacgacccatattttctataccaatccgttcttttcagtggaggatattgcatatctgtgcccagagtgcatcgccaacggcgaagcagcccggaaatatgacggtagttttcaagatgatttctctgtggacgatggtgtagacgatccggagaagctggacgagctgatccaccgcacccccggctactccggctggcagcaggaatactggcgcgcccattgtggtgactattgcgcctatttgggtaatgtgggagccagagaactgcgggcactgggtgtgctggaggaggtgctggacgacccgatgtgggacgatgagcaaaaagaaatgatccgggaatctgtcaatggcgggcatctgcaatgctatctgttccagtgcctccactgcggaaaacacctggtctggatggattttgattgaaaaggagacattactatgggacttgacatctacgccgggacgctgacccggtactattctcacaactggaaaactgttgtgcagcagtgggcggaggaaaacggatactctttcaaccgcatcaccccggacggggaacctgctgataaggaggaagaaatgtccccggctgaggtccaggcggcggtggagaactggcgggatcagatcttgagcgccatttctcagccgggccagcccccctacgctccctggcttgaaaataatgagaaaccttattacaccgacaagccggattgggatgccttcggcgctatgctgctggtggccgcctgtcgtacatacgaggaaccggtgccttccaccgtggagaaggactggatcttcggggagcatcctctggtcgcccgccttgcatcagatgaggagcgggtgtggtccctgtttcgtggggctacctggtggctccctctttctgacagctttctgttccaagggtccttgcctaccgatgacaccgccgctatcgccaccttgggcggactgcggaaggagctggaaaagctgaaccagctggcgtggcaggccgatgaggacactatccttggctgggcagacacggagggatacccggtagacggaaccgtagactcagatggacagtacagcaaggcagacatcccggaacacacccagtatgacactcaatcccttgccaagtttgccttctccatgttctggcgggccatgcgatttgccgaggagcagcaggtgcctatcctgcttgactattaaagagaattcgtcagggggtggagaccgtggaacaaaaacggccggcagatataattcaggaacttctggactacctgtggaacggcctgggcctggaggaaaagggctggaagcgtctgaaaaagggcgacttcaaaaagaaaatgaaaaacgggctgacctatcagatctggtttgaccggagccgctacaactacatagactacgaaatcggccatgggaatgtggaggtgggcttcagctgtatcataaagcagggagatgactacctctactctttcagaattgaacccacaacaggcggttcattctttcggatgctgacagaggacctgcggctgaacaccgggctgctggacacctttctgcccctggtcaaagccaactacctcgacttcatcgaccgcttcgaggcagaccccgtggaggcattacagccggtctgcgcccccttcaccgaggcggaggactacagctggttcatctatgtgcgggagcagatggtggaacggtacggaacggcggagcagatggaggagtaccgccgtcaggcggaattgcgcggaacgcctggacacaaggcaaagaactggatgggttcgatgttgttccacctctcccacgccaatgatgtggatcaagcctgggcctcaagccgcaccagagaggaactggaccaggtggtggaaccctttgtgcaggccaagcggcagacaggacagtggacacaggaggatgaggcgggctatcagctctaccggcaggaaacagatccgaagaagcgcacctttcgggtatggtatctcatcgccaacccccgcggcctgccgaaagagtttgtccagaaagagctggagtttcggtggaaactgttcccagaaaagaaggaggaacccaaatgagcaataaagctttccagcaaaatctggacgacaaaaaaggcccccagcccggaggtccctatctcattcagatgctgttcaaagagccggtagaaatgccggataaagaaaaaatgactgccataatggagaagcacatcggatcaacagagtgcttctgttatgataagaaaatggccggctttgccgccctggatcatgtcgcggaatttcaggacggcaagtacccggtacagctgatggtgatgaaatgcgacaagttcaagggcaaaggctttgatgcctttctgatgagccagatgtgggactgccaggaggaccgtgaccggatcttccgggagtgcaaatatcaggtggtggccaccgatatgctgactgcggcgcttccagcgctggagcgtgccaacctggatgccgactttctggaggctctggcagagctgtaccccacctgtgaggcgttctatttccagaactgcggcaagctgtttctggcagaggatgtgcgctcccatcagattgaggggccggatcggttcatccgctttggcgtcaatgtccgtttcttcaacatcgagggcacggaggatatgctcatcgacacggtgggcatgagcaccctgtttttgccggatctccagtaccacttccacggcatggaccccaactgggtggtaaaccacgcctataatgcagcgtcctatattctggagcatgataaccccattcaggatggggaaaccatagacggcgtggcggatagccagatgtgccgggaggtccagtggaagtgccagtatgaggactccctgatccagccgcccagaggggtgctggacatcaacatgggaaactatgcttcgggaggacgctgaatgaatggcgttgtgctcctggcaggcggacttctgcttgtggcggtgatcaagctgattatagatcgaaattggatcggcctgcttctctgtgctgtcgccctgcttctggtctttggggctggacaccatacaaaataggccattttaagaatcgaggaggtgaagtatgcagaattcaacaaatatgcggatactggaattactccggtttctctatgagaggaccgatgaaaaccatcccgccacagtatctgacatcattgcccatctgaatggaaaaggaattcaggcagtgcggcagactgtttacgcagataccaatgcgctgatcgatgcagggattgatattgtggtggtcaagagtacccaaaaccaatattttatgggaagccgaccgtttgagtatcctgaactgaaaatgctgacagacgcagtagcatcctcgaagatcatttctgccaagaaatccgaggaactggtacagaaattatgccgtctgaccagcacacatcaggcagaacagcttcaaaaatttgctgctttatccagccgtgtcaaaccgcataatgaaaaggtttactatatcattgataatatccaaacagcgattggaaaccatcagcaaattcggttccaatactatgaatatactcaggaaaaaaagaaaatcttaaagcacgatggatattattatgtcgtaaatccctatgcgcttgaatggaaaaatgaccattactatttgattggattttctctgaagcatcagaaaattgctcacttccgtgtagatcggctaacaagtgtagaaaatctggaaacttactttatgccgatagagggatttgatgtagcctcctatacaaataaaatggttgatatgtttacatcggagtcatcgaaggaagtaacccttctatgtgaaaacgaattgatgagagtaatcatagatcattatggagaagatgctgctgttgataggtatgatgatacacacttcacagccaaaattgaagtgaaccccagtggaactttttatggctggatattcaaattcaaagggaaaataaaaattctctctcccaaagagtgcattacggaaatgcagcaaatcgctcaggaatttatatagcgcaaaagaggtgttattgatttttaacacctcttttcaaatgaaatttttatccttgaagtgaacagatgttcgatatacaatataagcaagatgttcgcagttcgtcgaacaaatgagaggtgaatgctgtgggcaatataacttttggatcatttatagccgagaaacgcaaggcgcacaaattcaatttacgcgatacagccaagcatttgaatattgcttacggttatctgtgtgatattgagcaaagccgccgtcctgcacccaatggagattttgtggaacgcatctctgcctttctgaatttggataaatcagaacatgagttgcttttggatctggctgcaaaatcacgcaatacagtatctgctgatttgccagactatatcatggaaaaagatattgttcgggcagccttgcgtgtggcaaaagaagtagatgctaccgatgaagaatggcagacatttatgaaaatgctaaaggagcgtaaacgataggggggagagctttgtcaattccacaaatccgtacagaagcaatcgaggcagtagggcgaaaaatcctgatggaatatgatccctctctgctatccgggcaaccatgtcctgtgccaatcgaaaccattatcgagacaaagtttgatctaatcctggagtttcatacactaagaaaaaaccccaagatattaggggaaacaattttcgatgacggtgctgttgtcttatatgaccagatacagagacagtatcgaatgattgcagtaagagccggtacaatcttaattgatgaacggctttgtgatccgtcaaaattagggcggctccgttttacctgtgcccatgagctggctcattgggtactacataagaagttgtactctggtactggagatgttgctgcttataacggaaatgtttcttccgacgaaagtcatggcataattgagcgtcaggcggatactctggcttctgctctgctgatgcctttaccgcagatcaaaaaatgtttttaccggcttaaaataggccggacagatgaacagctcattgctgaaatggcaaatatttttgaggtttccaagcaagcaatgcagattcgtctaaaatccagaaacctgatataaccaaatgggggaatagagagaggcactgccctctctcacgctcctctgctatgctattttgtacctaatatgttcgcaatattgcgaacaaggagggatgttctatgagaaaagaaagcacaacaatccaaaaatgtaacagcaggctaacagctttggggcttaacagcgacgctgcgtttcatagaagtaagctgattctaaagatttaccgtgatgtagtctgggttctgagtgaacgggcagaagaattacaagaaactgcttggattatgggagaacaagatatagagtctggcctctgctatcttgaaaattttgcaccagatattgaactgcaagcctttgaagaaaaagtttgctgccttgttcaaaatcaaatgctagtcaatattattgaccgtgcactccttcgtctgaaacggtatccggatcgaggagaactttactatgaaattttgactaagcaatttatctatcggttcaacagtacagagaaagaattgctggaagaactaaatatagagcgcagtgtcttttatgaccgaaaacgagaagccatctatttattttctgtttgcttgtttggatattctattccagaagtcctggaggagctgccccgactaaatcccgactaaatcccgacaaatccccgacctaatccctactcccttccgacttccgacctgctatacttgttatagtggcaggaatgcgctaaattgaatacttttctacataaggcccggcattaaccgggcttttttcattcctgctgcaatatggcggcaggaacatggctggaggtgaaaacacttccggcctttttctttgcccggtattaggaggccggtatgcgctgggaggcgtacatagcaaaatatccatgacaccgttcaaattcgctgactaccaagaatttgaacggaggaaaggatatgacgagagtattcatttggaaaaataacagcccacaggaatgggaggaaatcagtttttcagcgttcagtaaggcacgccgcaatggttgctttactgggcgcttttttgttgaaacagtcaaaatgttccgtgatgaagatgaccgcattatcatggaatgttctcgcaaagattttgaaaaataccaacaggaggaccgccacagccgctatctccaggaacatgagaaaagtcgctctatattcccggcttctcatgtgggagatcgtgacggcacagaggaaggttatcaggatacagatttgtttgtggatgaatctgttgatactgcggaacaagctattcagaatttacttcttgaggatttacaccaagctctattgaaactgagtccagcagaacgagattttatattgtcctattatgaaatgaaaataccaaatgcaacttgtttagcccaacgatatggtattactcggcaagccgcagataagcgattgaaaaaaattgaagaaaaaataaaaaagttggttgcgattttctaaaaaagtggcagtagcaagtgagagggaaatcctttcacttgcaccttgacaacctcatatacgaatcattaagtttgatcctctttgggcgtaatagccgctacatcagcggtatattttctgagagctgccactcgcataacaggccaacccatttttgctgtatagatgagttttcggtttatcagaaatatatcaggctggaatacatcggatggcatccggtcatggcataacaaggaggaaagctctcttacagccatagtccgagcgtgataataaccgtcgcaggccatgggtaagaccaaacgaagtggaggtgaaactcctgagaagcaggccagccacctgcggcttaatgattacccaaatccctggggtgtcgtggacaagtaagggataaaacaggcgctaaattgaaggagactctgtaatttgcagagcctccttcttacataatcaaatctcaaaacataggaggatgaacatgaaagaagattggatttataagcgtggggatttatattatgccaatttgaacccttattttggatcagagcaaggcggcacccgtcctgtcctggttcttcaaaacaatgtggggaattttttctgccccactttgatcgtagctccactcaccagtaaatggattaagaaaaaggagctgcccacacactatgcactggagagcgttccagagcttggactgaaatctgttgttctgctggagcaaattaaaacgattgataaaaggcgtgttttatcgtacattgggcgcgtatctcgcgaagaaatgagagcgattgatgatgctctgcaagttagtttagatattcatattccggaggaaatggaggctccgtaaggccacttaccggataaaggaggcgtttttatgtttgaagcaagaattgcggaattgaaccgctttaatgaacaaaatcctgtcagctatgacaaaagaacctatacggtcgatgagattcaggacattctgggtatcagtcgtcccacagcatataatctggtaaaacagggtgtattccacagcgtcagagtcggcggtcatatccgcatttccaaaaagagctttgatgactggctggatcacgcagatgaatgatttgtcaaggatgccgatctccaaatcgacatccttaactttttttctgctttctcttacaatgaggccatagcaagaaaaactttatagaggaggcaaaagccatgcgaaaacaaagagtaaagaccagtatgtctgtaccagagatgggcaaaatgcttgggcttggtaaagtagaatcctactggttggttaaaaagaactatttcaaaacaattcaagtggccggacgaatgagagttatgctggatagctttgaagattggtatgccggccagttccactataaaaaagtggatggtacaccgcccggagagaaatggaggcatactacgatgtcagttccggaaatggcggatcttttggggctgaaatctggcacagcttatgaccttgttaaaaggggctattttgagacgaccttgattgatcgaagaattcgtatcattaccagcagttttgaagcctggtatcaaaagcaaactcattatgtgaaaatctcagaaaggagcaatgaaaatggcatctatcgtgaagcgtaaaagcaaatattctgtggtgtatgattacacagatgaaaacggaaaacgcagacagcgttgggaaaccttcagcacaaatgcagaagcaaaaaaacgaaaaaagcaaattgagtatgagcaggactctggaaccttctttattcctacggcaaagaccctgaacgatctgctcgatgaatatatgtccatctatggtgtaaatacctgggcaatgtcaacatatgaaagccgccgtggtctggcgagaaactacataactcctattatcggagatatgttactatccgacatcactccaaggatgatggataagtattaccgtgatctgctctctgtgaaaacggtaagcgtcaacaaccgcaaacccacaagcgaatatctgaccccgcatacagtaagagaaattcacaagctacttcgcagtgcctttaatcaggcggtgcgttgggaactaatcagccgtaaccctgtcctgaatgcgacacttcccaaagaagaacataaagaacgggatatatggactgccgaaacgctgagcaaggctatggaagtctgtgatgatcctatcctctcccttgccttaaatctggcgttctcctgctctttacgcattggtgaaatgctgggccttacctgggactgcattgatattgcaccacagagcatagaaaatggttcagcttatatattcgtcaacaaagagctgcaacgggttacacgaggtgcattggacgatttgagcgacaaaggtgttattaagaagtttccaccttgcatagccagtacccatactgctctggtcctgaaagagcctaaaaccaaaaccagtattcgccgcgtgtacctgccgaaaacagttgcctatatgctggtagagagaaaaaaagaaattgatgagctgatggatctgtttggagatgaatacatcgacaataacctggtcttttgctccagcaatggccgtccgatggaaagccaggtgattaaccgtgctttcaataaacttatcaaagaaaacggactgcctcatgttgtattccattctctccgtcactccagtatcacctacaagctgaaactcaatggtggcgatatgaaatccgtccagggcgactctggtcatgctcaggtaaaaatggttgcagatgtctactctcacatcatcgacgaggatcgctgcataaacgctcagcgattggaggaagcattttactcatccaagactcctgaccctgttgaagatacagagcctaaaactgcggatactgccgtcactgaaagtgatgaaagtgatgcagcgaagatactggaactgcttaaaaatcccgaaactgccgcactgctcaagcagctggcaaaagctttataaagtccctccctcagaagaacgcctctcactttgtgagaggttttcttcgtttgaaccactttgcacagtgaccaaacactttttttgttagcaaggttctgaaagcatttttgagcgatgttagcaaattcgcgattttgtttgcaacttcctctaatttctgctaacaaatgtttgcaagttcctttggtaaaaatcgaacctctgacttaccgcctttcttagcaaaaggccaaatctcgttagcaaatgttagcaaaccaaggttttttgcaaaaaagccacaaaagccgcagaaataagaaaagccgaaaaccctgataaatcaaaggttttcggcgtgtttgctggcgtccctggcgggattcgaacccacggcctttcgcttaggaggcgaacgctctatcctgctgagctacagagacttatattaaattgagactggcaacgatcacttttccccgtaaggcagctggtagagcacaaccttaggagggggctgttatatccatttaactaaggaaacacaactaatataatacaatatttttatgaaaatgtctacctgttttatattataaattatcgcattttaatagttgttatagtaatcatcgatagctgttaaaaataaacagctatcgatgacagatccaactaatcctgttcaggataattcactgctccctgaagccataccacacccttgaaccgtcttcccactttaggttcaccgaacagatccttcacattgatacatacatcaaaagataattcattgcagttgagcgtcatcacgcatatctcttcttctgtcagcctgttttttacaatatggcattctgtgatttcgccaaggacagaatactggtcacattccactccataaggcataaaataagtatccaccaggctgaatacatcttccttctggattctgcgggatatcgtggtataagtatccatatcctccagcgtcaggctttcaatggcatcctcatctccgcgccttgccgcttcgatcagctgattccttgtcaaggtagactgctgtatttttttcttctgattttcactcttgataatgggcatcataatggaaccctggattcccaaagcggacagcgtcaggcttgtgccccgcacgggaagcttatccgtattacggtatttaatgtagggtatcatattctgcaggtaaaaaatcaaagtaacgccaaccttaatatcatcacatacaccggcataggattccttggccgcatgacgttccacactcacatcttccatggagctgacaccggtaccgcgaagatacggataaaaataataaaatgtaaaattatcattttcatcaaattctccgcaaaccgcaatacccatattttctgcgaaattcttgcaaaactctaccaggacggtatcctcatttccattaagagtagtataatttctgctctcagggttcattattacatctttaaccaattcctggattttcctggtagtagtatattcactgaatcctatagactttaaaaatttatgcaggaatctcacctcgcttttcatatctgtacggttccattttatcttatctcagtcataccgcccatataaggctgaagcacagcggggatctttacggaaccgtctgcctgaaggttattctccaggaatgcaatgagcattctcggaggagcaactaccgtattatttagtgtatgcgcgaagtatttcccattttccccatttacacggatttttaatcttcttgcctgtgcatcgcctaaattggagcagcttcccacttcgaaatattttttctgtctgggagaccaggcttccacatcgtaagatttcactttaagatccgccaggtcaccggaacagcattcaatggtccttaccggaatatccatggaacggaaaagatcaaccgtattctgccagagcttgtcaaaccacatgggagattcttcaggcttacatacaactatcatctcctgcttttcaaactgatgaattctgtatactcctctttcttccaggccatgtgctcctttttccttacggaaacagggtgaatagctggtaagggttttcgggagttcttcttccggaacaatcgtatcaataaatttacctatcatggaatgctcactggtaccgatgagatataaatcctcaccttcgatcttgtacatcatggcatccatctctgcaaagctcataacgccggtaactacgttgctgcggatcataaacggaggaacacaataggtaaaccctctgttgatcatgaagtcccttgcataagaaatcaccgcggaatgaagtctcgcaatgtctcccattaaatagtagaaaccattacctgcaacctttcttgcgctgtccagatcaatcccattaaatctttccataatttccgtatgataaggaatttcaaaatcaggtactacaggttcgccgtatttggtaatctccacattttccgtatcatctttacctatcggaaccgaaggatcaataatattgggaatgagcatcattatttttgttatcttttcctgcagttccgtttctttttcttctaattctgcaagacgttttgcgccggcagccacttctgctttttttgcttctgcctcttccttctttccgtctttcatcaaaccgccgatttccttggaaatcttatttctgcttgcacgcagatcatctgcttcctgctgggtttgtctgctttccttgtccaattctattacttcatccaccagggataattttgaatcctggaatttctttttgatattttcctttactgcttcgggattctctcttaaaaatttaatgtcgatcatgataaggctcctctcctcatataaaattaatatcctattgctttatccaatgcttctttttcttctgctcccagggtgattgcacattccccttttttaacttcttttgtatatgtataacagccatcactgctctgaacagaatttaatataaagccatcatccttttcattcagaagagcgatgcagaagctcagctggcctcccatttggctaaaggcgtcatactttacaatgcccactttttgataacaatactcaagtcttttctgaatatcacgaatatcttttctgttcttatctgattctttctttataaaatcattatctttatataaaccttctatttcttcttcaagactctttgcttccttgcctttcataaatttggccaattttttctgaagcttgctcactttgctgaactgtataattataagaacaagaagcactaaaataaataccaacatgcctataagcacgtatgctatatccagtccccctaatcccatactctccattaaaccgcttgacattataatctcctttttcttttgtaaaaatagatcagttctttatgatgtattccataagcctgtccaaatcatcatgatcataaaattctatctgaattttaccggctccgttatccttagaggatatggataccttggttcccagtgattccttcagcttttcttctatattctgatagataacttctaatgatttattttctgcttttttcggtttttcaggtttgtggagattcttcactaacttttcgacttcacggacactcattttctcatcaaaaaccttttgggctatcatatactgctcttccggatcttctatagacaaaagagccctggcatgtccggtggttatcatttcattgactaccatctgctgtacttcatcacataacttcagcagtctcatggaatttgtcacggctgtcctgcttttggaaaccctttccgcaacttcgtcctgctttaaatggaattcattcagcagccttttatatgcctgcgcttcttcaatcggattcagatcttctctctgaatattttcaatcaaagatatctctactatttcctgatcagtaagattttttataattaccggtacttcctttaaaccggctatttttgcggcacgccatctgcgttcccccgcaatgatttcataataaccgtctctttcctgtaccagaattggctgcagtaatccaaattgctttattgattctgcaagctccaataaagcatcttcatcaaaattctttctgggctgatctctgtttggttccaccgcagttaatttaaccatggtttccggattcttattttctgttccggtccctttatcagcttttccctttgattccccaatcgtattaggaattaaagaatccaggcctttccccaatcctctagccgccatttattaaatatcctttctctttatcacttcgtttgccaatgccatatagctttccgcaccggctgattttggatcgtacattgtaattggaagcccatagcttggagcctctgccaatcttatatttctgggtatcactgtcttgtatattttctgattcagatttttcttaacattatctactacctgcatcgacagatttgttctggaatcatacatggtaaacagaattccctcaatctgcagctgaggattcaacctttctcttaccagatttaccgtatgaatcaattggcttaaaccttccagcgcataatattcacattgtatgggaactaatacggtattcgcagttgtcatagcgttaacggttaacatattcaatgaaggaggacaatcgataataataaagtcatactgatcctttatccagtctacttcattcttcagtatgtactcttttttatccacccctattaattcaatttcagccgccgctaaatttacatttgaaggcaatacggttacgttaggtactacttctttaataagacaatcctgtacactgcactctcccagcattaactcataaattgtattgtccaggttatttttatcaatattgaacccacttgtggtatttccctggggatccgtatcaataaccagaacttttttcccttttgcagccaatgcagctgaaagattaattgcagtggttgttttcccaacaccgcccttctgatttgcaattgcgataattcttcccattaaatttttcctttcgtttgcacttccacaaacatgataaagtcattcctcaacgacgctaaatttcacccgttcaagtactttacgattatatcactttttcaagttatattctataaggaaatattagaatttacctattctttttccataattcttgtatgacatgactttaaatgtttcacgtgaaacatcggctcactattttcataaaaataattcatgtaaaatagcaatcttctatgttatttgcttttatgttagcagatattttatatagaaaataaatcttctacattatttaaatattttcatgaatcatccattttctatattatcaaaataattcacataaaacatctatcatcttattatcaaaaaatattttatatataagtctatcacaaatattattaattttttacagaatttatttatcacttttataattaaaatatttaacaaataacttgcattctttatactatcaaataatttacatataacatttatcctttatatcaacaaataatttacatatagcatttatccttaatacaatctataagttatctatcagaatatagaagaaaagcttaatgtttcacgtgaaacatctataattcatattctaaaaataatcttcgcaaaataatactctccataaccctacaaattttaacctgaaacatcatcttactatatttaaatatactctaaaaaatcttacacatatctaaatacatctcacatataaatcatatgctgcatcttaaataagattttatattaacatcacacttaaacactacctctaaaaaatatactttgcagcccggcatatgttgattctggcccgcccggactttctctcccttcccctgccctctgtgtaccaatgctttgccagggctgctgttcagcaaggattcctgtaaggaccgtataaatacgccggtccttaggttgtgtattttgcaaccttagtaccgctgcgtatttatccgagcgaaagcgtgtccacacaggaaccttgctgaacagcagccctggcaaagcattggtacacagagggcaggggaagggagagaaagtccgggcgggccagaaccaacatatgccgggctgcaaagtatatttttgtcctcccccaccaacatccaagaaggattttcttgtaagaagcaagcgaatggtttataatacttaaatacaggaggtattaatatgaacaaaaaactaggcacagctatactattaaccggcataacaacgttcacaattcatatgataaataaagtacagttttcattcagtactgttaaaaatattctaagttgtccaaataacaaatattatgagtggagattcggtaaaatcagatatattaaaaaaggatccggatcacccgtgctgctgcttcatgatttaacacccggaagctccagctatgaattttccgcaatcatcgatgaactggcagaaaagcatgaagtttatgcaatcgattttctcggatatggtttatctgataagcctaatataacttataccaattatctgtatgttcagtcagttattgattttatcaaagtaatcatcggaagaaagacaagcataattgcgacaggggatgctgctcctatcggaattatggcatgtcataatgacggtgaagtaattgataaaattcttctgctgaatcctcagagtattaataagttaaatcagatacccaataagcagacaagacttttgaagtttttaattgatactcctattctgggaacattgctgtataatatacagactacaaaagaatctttcaaaaaagtattcctggaagaatactttgaggaatctgttaatgtgaaagaagaaatgttaatgagttatgttgaggcttctcatcttccggatttcaacgccaagttttcttttgccagctttaccggaaggtatatgaatgccaatatcattcatgcattaaaagaaatagatcacagtatttacattttatatggtaagtctaagaaggatatagaaacggtagtagataattatatatactttaatcaatccatagaagccttcgggatagaaaacacgaaacatttatgtcacttagaagcaccctctaaagtaatggaacagattaacattctattataaaacaaagcataaaaatgatccctgattatccggggatcatttttattatccaatgtttcacgtgaaacattattaaactatttacttttcataagtcatttaacaatcggttctttagcaggaaggccagcttttctgggatacttcttaggagttacagatttcttctcaatcacatataaaattctataaatgtcactatccggaagataaaaatctttcttatccttaacatcaccgccgagtatatgtatcgccttttctgctgctgcagcttcttcttctatcttttctgatttataggaaataaattgcccgcccactctcacaaagggcaaacaatactctgataacgtagaaagattagcaaccgctctcgaaacacaaatatcatatttttcacgaaatagagaaggcttcgcataatcctcagctcttccatggactgcttctatatcctcaagtccaagcttatcaatcacttcattcaaaaacttaattctcttatttaaagaatccaataaggtaacctttaaaccgggataagcaattttcaaaggtatgccaggaaaaccggctcctgttcctacatcaattaaagataactttttttcttccaattcaggtacagccctgataagagacagactgtcaataaaatgcttctttaaaacttcattaaactcagtgatagcagtcaagttcatgacttcattccactgtaccagcagctcataatataaaataaacttttcttcctgctcctgatttaatataaccggaagctgctccaaatcttttctgaactgcactaaattataatcactcattctgactcctgttttgcctgatgttccaaataaactaaaaggacagaaatatctgccggcgatacaccggatatacgggaggcctgtccgacggataccggcttataagctatcagcttctgtctcgcttccaaacgcaggctggatatatcctcataatctatccatgacggaatttttttcttttccattttcttaaactgttcaacctgacgcatctgcctggtaatataaccttcatactttaattctatttcaacctgctctattacagcagaagataactgcggtcttccgggatcaatttcggctaaagcagaatagctcagttccggcctgcacattaactccgaaaggctggcagctgttttcagaggggaactttcatgctcctgcaagaacctctgtatctcgggcgccgccccaaccaccgttttcttcaaacgctccatttcctcctgaatcagcatctgctttcccagagtagacttataatcctcttcactgacaagacctgcctgatatcctatttcccgcagcctgatatccgcgttatcctgtctgagaagcagccggtattcagcccgggaagtcatcatcctgtaaggttcaaaattatctttggtaaccagatcatcaataagaacaccgatataagcctgggaacgatccagaataatctgttcttttccctgaatagacaaaccagcattcatacccgcgatcaatccctgagccgctgcttcttcataaccactgcttccgttaaactgtcctccgctgaacaatcccctgatattcttaaattccagcgtcggattcagctgcctggcatttatacaatcgtattcaatcgcataagcattccttacaatcttacagtgttccaatccaggaacacttctgtacattgcaagctgtacgtcttcagggagggaagatgacattcctcccacatacatctcatttgtatgaattccttccggttccaaaaaaacctgatgtctctttttatccgcaaactttaccactttatcttcaatggagggacaatatcttggtcccgtcccttcaataattcccgcataaataggagaacgatccagatttgcgcggataatatcatgtgtttcttcattcgtataggtaagccagcaggatacctgatccttctggatactgtccggatccgtggaaaaagaaaatgggattatcctgtcatctcccagctgttcttccattttggtaaaatcaatcgttcttttatccatacgcgcaggtgttccggttttaaaccgtctcatctcgactcccagattctttaaagagtctgtaagatgattggcaggctgcagcccgttaggcccggtataggtaatcgcctctccgcataagcatctggaattcagatatgttcccgtacataaaacaacggctttgcactcataaaccgctccggtaaatattctcacaccggtaatccgcctgcttacggattttccttttttctcatcctcttccgtcatattttccgccagcagttcgcatacctcagcctgctttatggtgagatgctcctgattttcaagaacccttctcatctgccaggtatattccgccttatccgcctgggcccgcagcgaatgtaccgcagggcctttggatgtattcaacattttcgactgaataaaggtcttatctatatttttacccatttcgccgcccagggcatccacttccctcaccagatgtcccttggaagatcctcctatattaggattacagggcatcagcgcaatgctgtccacgctgactgtaaagattatggtttccaatcccatcctggcacaggccagggccgcctcacatccggcatgtcccgcgcctaccacacaaacatcataaacttccctgatttgcgacataataaactgctcctttatttcttctttttcttattttttttctttttctttttttcctgtaccgcctgtggcacagaaacgacggtgggtactgtttccctctccacatagatacgctgattggattccggtacaataatcgccgtttccatttcttcctcagaaagaacgacgccggaagaatcctccgccgcagcagaaccttcatttatggggttgcttctgttatccttccgggtttcctgaaccttcccccaggcctgatcccataaaagcttcaccggttcccaaaccagttccagcgcccgcagcaatgcaataataagtatcacccaacagattaaatgatacagctggatttccccgctcccataatcatcggtagccccataaaacaagccaagtcccacaatacctacagccatcagaaaaaaaagtcccttgcctgattctttcctcatatccgtctgctcctgtcccttattttgcatttccttcaaatgggctttatcatctgcagaaatacatactcatggattcatcataccacaaaaaaaaataatagaaaacacgtaaagttaatgataatataaaatagtacgtactgctgcaatttgctattcagccttaactatatacacaaaaaagtacatacctgagcacacggataaaagtaaacctaaagactatcttattatgaaaggattctattactatgaaagggctatattataacggaaccgctgcagaatacagggaagatcttcccatgcctgttcctgaaccaggcgaaagcctgataaaaattcattacagtgccgtatgcaatacagataaggaaatccggaaaggataccgtccgtcattccgcggagtcatgggacatgaatttgtaggagaagtcgtctcttctccggatcccgtctttcatggaaaaagggtggtgggagaactgaatgccgcctgcggtacctgtatctactgcagaacaggaaggcctacacactgttcaaacaggaaagtgctgggcatggattccaaagacggatgcttcgcggaatacatgaccatagatacttccctgcttcatattgttccggatgaactccccgatacacaggccatatttacagaacctcttgccgcagccatggaaatccttactcagattcatatatccccggacaaaaatgccgctgtcctcggagacggcaggctggcccttctcacagcccaggttttggctctcaccggtatcgatcttaccgttatcggaagacatccggaaaagctagagcttttccgtccctttgcaaaaacgaccacctgcggcgaaaaagaaggctatgaatatgtcgctgaatgtaccggttcggaaagcggccttcctcaggcgatggagcttgtgcgaaaaaaaggaaccataatactcaaaagtacctatgcaggtaaagtaagtctggatatgagtatgactgccgtaaatgaactcactattgtgggaagcaggtgcggcccgtttgaacccgcactccggcttctgaaggataaaaaaatccatcttcccgaaatagaactctatgatctgaaggattttgaaaaggccttcgcatcacccgcctttaaagcgggctttgcctttatcgactgatatatgttaaaaggaacacgtcatgtatcgtgttcctttttccatgcaaggatacgattcagcttttcctttacctccgcttccttcccttctcctgcaggcacataatatctcttatcctgaagggaatcaggcaggcagcgcatggccgtaaccttttcctccgtattatgggcatatacatatccttccccgtaatgcagttcttccatcagacgggtaggcgcattccttatctgcagaggcaccggctccgcaagcattttcaccgcatcctccttacaatcctcatatgccttataaagggcattggatttgggagccatggacagataaactaccgcgtgggcaagattaacattacattccggcattccattaaaatgacaggcctgatatgcggctaccgcaaccaaaagagcattactgtccgccagacccacatcctcgctggcaaaccggatcaatcttcttgccacatataagggatcttcacctgcctccagcatcctggaaagccagtatacggcagcgtccggatccgtattccgcatggatttatgaagagcggaaatcaggttataatgctcctctcccttcttatcataaagaagggattttttgctggtgcactgttccagtatttctctggttatgacagtggttccgtccggtttgatctctccgttcaggatcaccatttccagtgtattcagagccgtccgcccatctccattagcaaacctggctatcatctctatcatgtcttcttctatttcaatcttctggttaccgaatccgtttccggctttcagggcatgatgcagcagctgcacgacctcttccacggaaagagcctgcagcacaaaaaccttgcagcgggaaagaagagcggcattaatttcaaaggatggattttccgtagtcgctccgatgaggataatacttcctttttccacaaagggcagaaatgcatcctgctgggccttattaaaacgatggatttcatctacaaatacaatcgtcttttttcccatatgcctggcgctctcggcctggttcatcacttccttaatttcacggatcccactggtaaccgcactgaaatcaatgaattcagcctttgtgctcctggctattatcctggcaagagtagtctttcccacaccgggaggtccccagaagatcatggaagaaaccatatcctgatcaatcaggcggcggagaaccttcccttcccccaccagatttttttgtcccacgaattcctccagtcctgaaggacgcagcctgctggcgagaggatcatacataactctgttatcatcaaataatgacatttgttccattttattttcccatgcagaacttactgaaaatttcgtttaccagatcttctcctacctcttctccgatgatatatcccagggaggcataagcactcatcaaatctatggaataaaaatcttcgggcatctcatcttccaggcttttctttaccatgagcagactgtcccgggcttcttccagcgcctgcttatggcgcatattggttataataacctcttcattcatggaaagggcgccggagaaaaacatttcttttatggtattttcaaattcctcaattcccgtattatcccgggtggaggtacgtatcaccgagatctccgcatcccggagcttctttctgagttcctcttcctcaacaacgggaaccagatccgttttattcagaagcacgatgcatttttttcctctgatcaaatccaggatctcctcatcactctcatctaatgcgacggaggaatccaccacatacagaatcagatccgcatcagaggctattttcagcgcccgttccacccctatcttttcaacaacatcctctgtggaacggattccggcggtatcgatgatattcagaccaatcccgtgaagcctgatggattcttccagtacatccctggtagtcccggccacctccgtgacaatagccttttcttccccaaccagcagattcataagagaagattttcccgcgttgggctttcctacaataacggtattgatcccttcctttaacacttttccgtcgtcagcggaatcaatcagcttattacaccgtaataatagatccccgatctttggaagcagcttttccggatagccctccgtgcttatatgttcgggatcatcaagcgctgattcaataaacgctatctcatataaaatctcttccctcatctgcctgatacagtcggaaatggatccctttaactgcttcatggaggatttcagggcaaattcattccgggaatggataatatccataaccgcctccgccttcgctaaatcgatccttccatttaaaaaggcccgcttggtgaattcaccgggctctgccagcctggccccattcctcagtacggtttccagaactttctgcacgattaagacaccgccatgacaattgatctcaacggtgtcttcttttgtatagctattcggcgctttcataacagcggccatcacttcatccaggatttcttccccatccataataaacccgtaatgaatggtatggctgccataatccttaagactatggcagccattctttgatctataaaccctgcttccaatttcgattgcatcgtctccgctgatacggacaattcctattcctgaatcagacagtgccgtagcaattgcagcaattgtttcagtctgtttcataaatcttttaacctctgcccctttgtcagacagttatctgtctgttatcttttcagggtaacaacaacatggcggaaaggctcttccccttcgctgtgggttgtaacatatttgtcattctgcagggcggaatgaattattcttctttcataaggattcataggctccagggaaacactgcgtttggtcctctttaccttatatgctatgttctttgccagattttccagggtttcttttcttctcttacgatagttctcggtatctaccttaacgcggatatattcttcggcttccttatttacaacaagggaaacaagatactgcagggaatccagagtctgtcctctcttaccgatgagaacacccatgtcatcgcctcttaagtcaacatcaagaaaaccttccagctcgtcatatttcacatcaattactacagtcattttcattgcggcaaaaacatcttccaggaagtttttagctttatcttcaatgctttcttttacttttgccttaatttttgcaggcttggaattaaatcccaggaaaccggtagaaccttcttctattacctcatattccagcttatcactggttacaagaaatttctggcatgctgcggtaatggcatcatccactgtcttggcagtaaattcaacgaattccataatttcctccattctgccgccgggtgcggcaatccattcaagcgtatctttcgcttatttcttatcggaattacttttttccgttttattgttgttctcgttgtaaatctttaccatatttgcctttgcagctatacttcccggcttcggagccttctgattatacatttccgttgccttcttcactgcttcctccttctcctcctgcgtcatggatgctttcgccgaagaagcttttgtggagatactgtttgattttggagtcgtgctctgcacgttccgcgtattcatgctggcatattggttaattgtctttggatcaataccggccttttccatcctcttaatccgtttatcctgctttttcttagccttgtccttgtttttctcaataagctgatcgaaatcggtcttatcaatatgcttgtttaccaggacctgctgtatactccttaccaccgcactggcaacccagtataaaccgacaccggcaggaagagagaaacagaatacagccgacataataggcataatgttattcatcattttcatggaagacatcatgctgttctgatccccgttagattcaggctgaggcatcagcttaacattcagccactgtgttaccgccgccaatacagggatggcaagagctgctataataagaagcacattcttggactgcatggcattggacagataataagaaggggaatcccctatattcattccaaacagattattataagatcccagcttttccgatgtagccatgatatcattcgccagagaagggaatttatcagccaggctgtgccattccggagtggacgctttattcaggacatcgataaatgtattctttacataagtgggatcccctgcaacaaacagttcattagagaactgcttcatatacatagccgaatttttgaatccctgaatgaattccgcactgccgggctgggcaatcagattctcaaccaaaggtgaaaaaaccgccttaacctgtccgatataagcaggaatcgcataaattaccttatacaaagcataaattataggaagctgtatcagcatctgaacacagctgcccataggtgaaacaccatatttggcataaacggcctgcgtttcattctgcatagccatcatggaatcattgtctttcttaccattatacttcttctgaatagcctgaagctcaggattcatcttattgctcagtttggaaaacttctgctgtttaatagtcaggggaagcatgagcatataaattacaatggtaaatacgataatagcaagagctatatagggaagtccgatcagattcagcagatagaaaattccctccataatataaccgagcaatgtagcaacccagcctataacgggagtcgcacttttggtcaaaataattcctggcaaatcttatttcctccttaaaccggcgccggactaaggtaccggatcataacctcccttggaaaagggattacatcttaaaattctccaaaaagcaagcaaaccgcccttaattactccgtacttctccacagcctgtaaaccatactcgctgcaggtaggaaaataagggcattttgtacttttcatcggtgatatatactttctatatcctttaattaaagcaattactatcttcttcattttcgaatcagctcattattttatgaagcttacctaaatgcaataacgcactctcgatttccctgaaggaagccgaagctgcattcgctctggccacgactactatatctaaaccactattaaatatattttcctgcagcctgtagctttcgcgcaccagccttgtgacatgatgccgcacaacactgttaccaacctttttgctcacggaaattccaagtctgtttttatccaaattattttccaacacatacattaccaataaacgattggcatacgatttgccattccggtaaacagactgaaaatcctggtttttcttcaaactttccgaaaaattcattacatgtccaatctttcctggaaagagaaaaaaaggccacaaaactgcggcctatgctgataatctctttcttccttttgctcttcttgctgccagtacctttcttcctcccggagtactcattctggctctgaagccgtgaactttatttctctgcctgttcttaggctgaaatgtcattttcattaaagatgcacctccttcactcaggtttctgataatgtgtcagaaaatatcattaccgattatataggaagaaaccccgcaagtcaagcaaaaccgcgtattttacgaaataaaaaaacgctgaaaaaagcctgtaaaaatcgtgtttttcactaatacaagatatagttatccccaattatttttttccacaacatctagcatcccgattttcatccacatcctgccaaccgatcaatccacttaacataacattatccacaaattgtgtataacttgtggataaactccgcttaattttcgttttcaaattaaaaataaatatcaaagccccatattttctgaatgtttatatgttgatgacacttttccacttatccacatttacacatagcaaacccgtaatatgttaactactccccccttgcattcacagtatgtggaaaaatattatccccataattaacatttgatatttgcttttttttagagtaagataatataaatgtattttcagtaagtttatggaggtttagcaatgcaggcaatcgaagccagatgggatgagattaaggaaacaatcagaaaggaatatgatctttctgacgtttcttatcacacgtggatagagccactgaagttttatgacgtccaggatgatgtggtaataatccttatcacatccaaccagtcacatgcccttaactatatttcttccaaatataaggatttcttccgtgttaccctcacagaaatgatggatcattactatgaggtctcctttatattggaaaaagacgctaagaaggacaagtcttccactgaagatctcaaatctccatacagcagcacctttaacattaattatgaaaatgcaaatctgaaccctaaatataaattcgataccttcgtagtgggaagcaataacaaattcgcccattctgcctgtcttgccgttgcagaatccccgggtgacgcatacaatcccctctatatatatggtggggccggattgggcaaaacccaccttatgcattccatcggacatttcgtgctggaacagaacccggatatgaaggttatctacgtcacttccgaatcctttactaatgaagtaatcgaatccatccgaagcggtaatgcggcggccatgaccaagctgcgggacaagtaccgtacggtggatgtcctcatgatcgatgatatccagtttataataggaaaggaaagtacacaggaagaatttttccatacctttaatgtgcttcatgccgccggcaaacaaattgtactgtcctccgataaaccgcctaaagaaatggaaaccctggatgaaagattccgttcccgttttgaatggggccttatcgcagacatccagccgcctgattatgaaacccgtatggctatcctccgtaaaaacgcggagaactatgataaaaaaatcgacgactccatttttcagtatatcgctaccaacatcaaatccaacatcagggaactggaaggggctttcaatcgtatcatcgccaaatcaaagatcgaaaaccagccggaaataaccatggaactggctgaggacgctctgaaagacatcatcaatcccgacaaaccggacaaaataaccccggaactcatcattcgtgtggtggcagagcattacggcgtgaatccggaggacatcacctccaaaaagaggaattccgaattcgttcttccccgtcaggtagttatgtatctgtgcagggatctcacggaaacctctcttgctaatataggaaagctcctcggcaaaaaagatcataccacagtaatccatggtgccaataaaataacggatgaacttaataccaatgaagaactgaagaataacattgaaattatcaaaaagaaaatatgtgtataactttgttaaagaaaagttgacaagctgtgggtacattggggacaggctgtgaatccttattttttcagagccaaaccgaaatcaggaggttcaggtccattgtgaataccttgagaattaacctcagcttatccggcacttttgaacaagttattattttcaaatttccttgcaaactgtataataaaaagggttatccacatatctacatccactactaattaatattactaaataatttaatttataaaaagatcgcgcgcggtgcgccaggcgctgtgtcattgtgaattcgcagaagggagtttatgcacatatgaaattagtttgttccaaaagcaatctgttaacaggacttcaggtcgtatcgaaagcagtaccgaataaaaccaccatgtccatccttgaatgtattcttattgattccacctcaggggagatcaaactgacggccaacgatatggagcttggtatcgaaaccattatagaaggggagatcctggaaaaagggatcattgccctggatgccaagatctttttggagatcgtaagaaaactgcctgataacgatatcaccatcacaacggacagtaactttaagactgccattacctgtgaaaaggctaagtttaatatcatcggcaaatcaggtgaagatttttcctatttacccatgattgaaagaaacgaatccattattatttcccagtataccctgaaggaagtgatccgccagacgatcttttccatctctgacaatgacaacaataaactgatgagcggtgagcttttcgagatcaacggagaggaaatgagagtcatttcccttgacggacatcgtatttccatccgtaaaatccatctgaaaaactcctatcctgccaagaaggttgtggttcccggcaaaaccctgaacgagatcagcaagatcttaagcggtgatgcggataaggatgtcaccattttctttacggataaacatattgtatttgagtttgagaataccacggtggtatccagactgatcgaaggggagtacttcaagatcgatcagatgctttccagcgattatgaaaccaaagtgatcattcataaaaaagaactccttgactgtattgacagggctaccctgctcatcaaggaaggggataaaaagcccattatcatcaatatcacggacggttccatggagcttaagatcaattccacggtcggaagcatggatgaagaaatcgatattgaaaagatgggaaaagatctcatgatcggctttaatcccaagttcctgatcgatgcccttcgtgtaatagacgatgaaacaattaccatttatctggtaaatcccaaggctccctgctttatcagggatgaagaaaacaattatatttatctgatcctgcctgtaaactttacgacagtttcataagcggaaggaaaacaatggaaagctttaaaataaaagatgagtatatcaagctgggacaggccctgaaggcttccgggcttgcagaatccggtgtggatgccaaatatgcggttcaggacggatttgttaaggtgaacggacaggtggaaacccagagagggaagaaacttgtgcccggagatcttgtggaatataatgggaatactcttaaaatcgagtaaaataaaagatcccgcagaaagctgacgggaaataaaagaatacggccaaagcggctgttgtgaatgatcaaaaaaggctggtttacataaaaccagccttttgaaaggcaatatcgggtaattttcatggtaataaaatcgcttgagctgtccaatttcaggaactatgcgtttctggatatgaattttgacaaaggcaccaatattctttacggcgataacgcacagggaaagacgaacatccttgaggcgatttatttgtgtgccacgacaaaatcacacagaggcacgaaggatcgtgatattgttaattttgatgaggaagaagcgcatatccgcacctatttggaaaaagacggggatgagatcaagatagatatgcatcttcggaaaaataaaaccaaaggcatagctattgacggcactaaaataaaaagggcctcagagcttctggggcttatgaacgttgtattcttctctccggaggatctcagcattattaagaacgggccttcggaaaggcgcaggttcgtggatatggaattatgccagcttgatcctatgtacctgcatcatttaaacaactataacaagataataaaccagagaaacaagctgctgaaggatatgtatatgaatccttctttgaaggggactctggatgtatgggatatccagcttgtggagttcggaaaaaagatcattgaaagacgtacggcttttgtggatcagatgaataccattataggcgggatccatgacagcctttccggagggaaggaaaagcttctgctctcctatgaaccggatatttccccggaggatttcgaaggaaaactgcgtggcagccaggaaagggatatccgtctgaaacagactacggtggggcctcacagagatgattttgcttttatcgccaatgaaatcgatatccgtaaattcggatcccagggacagcagaggactgcggccctttccctgaagctgtcggaaattgaactggttaaaacgatgacaaaggatacgcctattcttcttcttgatgatgtcttatccgagctggacagcaacaggcagaattatctgctgaacagcataggtgatatacagacaataattacctgtacaggcctggatgaattcataaacaaccggtttgagataaaccgggtattcaaaattaccaatggttctatcgatattatgtctattgtggataaataaaattcatgttataataaaacagaataggcaaacaggtagaaaaacttatagacctgagggttctataagcttttctatctatttgtgtcctttttgttgaattttggtcttttttagcagtgaaatggaggaatatatgggtactgaaaacacagaaagccacagtgagtatggcgcggatcaaatacagatcctggagggtctggaggcggttcgcaaaagacctggtatgtatattggttctacatcagccagaggccttcaccatctggtttacgagattgtagacaatgcagtggatgaagccctggcgggttattgtgataccattgatgttacaattaatcaggataattccattacggttattgataatggacgtggtattcctgtggggatcaaccataaagccggcatccctgcggtggaagtggtatttaccattctgcatgcgggcggtaaattcggcggtgggggatacaaggtatccggcggacttcatggagtaggcgcatctgtagttaatgccctgtcagactggcttgaggtggaaatttgtcaggaaggaaaggtatacagacagcgttacgaaaagggaaagactatctataccctgaaagtggtgggagaatgtgatccggaaaagacgggaacaaaggtaacctttaagccggatgccactattttccaggaaactacggtttatgaatttgatattttaaaacagcgtctgcgtgagatggcatttcttaccagaggtttaagaattatactcagagatgtgagggaagaaaatccgcaggaaaaagtgttccactacgagggcggaatcaaggaattcgtcacctatctgaataagagcaaatctcctctttacgaaaatgtcatgtattttgagggcagcaaaaataatgtttatgtggaagtggcaatgcagcataacgattcctacacggaaagcgtttacagctttgtcaacaatataaatacaccggaaggcggcacccatctggtgggcttcaggaatgccattaccaagacctttaatgattatgcaagaaacaataagctgctcagggacaatgaagcgaatcttaccggtgaggatatcagggaaggcctgactgccattgtcagtgtgaagattgaggatccccagtttgagggacagaccaaacagaagctgggaaattccgaagcgagaggcgctgtggacagcgttatcagcgaacagcttacctattatctggaacagaacccttccattgcgaaaaccatctgtgaaaaatcaatccttgcccagcgtgcaagggaagcagccaggaaagcgagggagcttaccagaagaaagacggctctggaaggaatggcgctgcccggaaagctggctgattgctccgataaggatccgaaaaactgtgaaatttatatcgttgagggagattccgccggcggatctgccaagaaagcgagaagccgtgccacacaggctatccttcctctgagaggaaagatcctgaatgtagaaaaggcaaggcttgataaagtgtacgccaatgcggaaatcaaagccatgatcaccgctttcggcacagggatccatgatgatttcgacgtaaccaaattaagatatcataaaattattattatgaccgatgccgatgttgacggttctcatatcgcgactcttctgcttaccttcatctaccgtttcatgccggagctgattaagcagggacatgtttatctggcgcagccacctctttataagctggagaagaataaaaaggaatggtatgcctacagtgatgaggaactgaatcagattcttacggaagtgggaagggatcaaaataataaaatccagcgttataagggtctgggagaaatggacgcggaacagctttgggaaactacaatggatccggaaaagcgtattttgttgcgcgttaatatggatgaggaggcagaatcggaagtggatctcacatttaccacattgatgggtgataaggtggagccgaggcgcgagttcattgaagataatgccaaatatgtcaagaacctggatatctgatgacagatactgtagaaacggagagtcaataaacaatggaagataatatttttgataaaattcatgaagtcgatctgaaagaaaccatggagaaatcctatatcgactatgccatgagcgttattgcatcccgtgcgcttccggatgtccgagatggcctgaagccggttcagaggcgtgttctctattccatgatagagttgaataacggtcctgataagccccatagaaaatgtgcccgtatcgtgggtgataccatgggtaagtaccacccccatggagacagctccatttacggctcccttgttaatatggcccaggaatggtccaccagatatcctctggtagacggtcatgggaattttggttccgaagacggcgacggtgccgcagccatgcgttatacagaagccaggctttctaaaatttccatggaaatgctggcggatatcaataaagacaccgttgactttgtccccaactttgacgagacagaaaaagaacctaccgtccttcccagccgctatcccaatctgctggtaaacggaacctccggtatcgccgtaggtatggcgacaaatatccctccccacaaccttcgtgaggtagtggacgcggtggttaagctcattgacaaccgggtgaatgaggacagggatacggatatggaagaggttctgcagatcattactgcccctgactttcctacgggcggtattattctggggaccagaggaagtgaggaagcctaccggacaggacgcggcaaggtacgggtccgtgcggtaacggatatcgagacgcttcccaacggaaaaagccagatcatcgtaacggaacttccttacatggtgaacaaagcccgtttgatcgaaaagatcgcagagcttcacaaagagaaaaaaatagacggtattacggatctgagggatgaatccaacagggaaggaacccgtattgttattgaactgcgcagggatgccaatgctaacgtgatcctgaatctgctgtacaagcacacccagatgcaggataccttcggtattatcatgctggctctggtgaataatgagccgaaggtgcttaaccttctggaaatgctgaagctttatctgaagcatcaggaggatgttgtcaccagaaggacgaaatatgatttgaataaagcggaagaacgggatcatattttacagggcttgctgatcgccctggatcatattgacgaagtgatccgtattatacgttccagcaggaatacccaggctgccaaggaaaacctgatggaacggtttgagctttctgatccccaggcgcaggctatcgtcgacatgagactgcgcgctcttaccggtttggaaagagaaaaactggaaaatgagcataaagagctcatggcaaaaattgccgaactgaaggcgattttggcagatgagaagcttttgcttggcgtaatcagggaagagatcctgattacctccctgaaatacggggatgacagaagaagccgtatcggttttgacgagtatgatatttccatggaggatatgatccccagggataatacggtaattgccatgaccaatctgggttatatcaagcgtatgacaattgataattttaaatcccagaaccgcggaggcaaggggatcaaggggatgcagaccattgaagaggatttcattgcggatctgcttatgactaccacccatcattatgtgatgttctttaccaattacggcagggtttaccggcttaaagcctatgaaattcctgaggccagcaggacggccagaggaacggccatcatcaacctgcttcagctgaatccgggagaaaagatatcggccattattccggtaaaggattatgaagatgataagaaccttttcatggtaacaagaagaggtatcgtgaaaaaaactcctgtcatggaatacagcaatgtccgtaagaacgggcttgcggcaattaatctccgtgacgatgatgaattgatagaagtaaagatcactgatgcggatacggatcttttcctggtgaccaagcacggcatgtgtatccggttcaaggaaaccgatgtaagggcgaccggaaggatgtccatgggtgttatcggaatgaacctggacgacggggatgaaattgtgggaatgcagctggacagccagggagattccctcctgatagtatctgaaaacggtatgggtaagcgtacttatctggaagagttcagtgtccagaagagaggcggcaagggagtaaaatgctataagatcaccgaaaagaccggttatgtggttggcgttaaggcatgcaacgatgatcatgaaatcatgatgatcaccacggaaggaatcatcatccagttaagagtggaggatatttccatattgggaagaatcacttctggtgtgaagatgatcaacctggataaggggatcaaggtagcgcaggttgccaaggtaagggaaagagtttctgacggcagccaggaatttgaaaatccggatgacgccatggaggatattcctgaagaggaaagatatccgggggcggatgaagaagaaaatattattttccctacggaaactgaggaagaataaagagtcctaaaagaaaattcacggttcatgaagccgtgcggaataagcagacagccgtaaaggcagtctgcttatttccttacagggagtaaagatatgaaaaatatattgattgtggaagatgacaaagctcttgcggaaggaatcgtgcttgttttgcgtcaggacggcttttccttccagtgctgccataatgtaaaagatgcaaagaaagtactggaaaaaaacatttttgatctcattcttttggatatcaatcttcccgacggaagcggactggatatatgcagggggctcaggaaggaagagaggttggatcctgttattttcctgacggctctggatacggagcttcatgaggtcaccggtttccaggcaggagcggatgattatattaccaagcccttttccctggccgtattaagggaacgggttatggcggccctgagaagaggggagcggcgaagttcctccgggaaggcttcaccggtacttagggaaggcccatttaccatcgattcggagaaccagtccttttttatgggagacagggaaatccttttaagcaggacggaacaaaagcttctgatggtactgattaaaaataaaaaccggattctggaacgggatactctgattgaaaaggtatggggaaacgacggggaattcgtggatgaaaatgccctttccgtcaccattaaaaggctaagggacaagctggagaaagatcccaggaagccggagtatatccagactgtttatgggataggatatcgttttcagataaatgagggagagtcacaatgactgcgtatttaataaagggtttctatggaaatgtgcctgtgattttaatgtcggttactgtaattctgcttgccgggatccttatttatgtgcttgtcaggcttcacagggaatatgatatgctggataagatgctggacagcgcaatcgaaggaaatttccaggaaaaaagatttgatgaatatatgctctccaggctggaaagcaaattatatcaatttttatcatccagttctctgggaaggaaaaaggtggaggaggaaagggggaaggtggaagaacttatagccaatatctcccatcagaccaaaacacccatcaccaccatacgtctgtacgcaggcctgcttgaggaaaaagatctgccggaggaagaacatctgctggccagacggattgcggagcagaatgacagaatggcatttctcattgaaaacctagtgaagatgtccaggctggaaaacggaatcgttgccgtacatcctgtgaagcaggatatcgcagtccttatggaaagcctggccgggatctttgaaaaaaatgaggaaagaagaatcctttttgatccctcttacagaagtcaggagccaatcattgcctgctatgatttgaaatggacggtggaggctatttcaaatatcatagaaaatgccataaaatatacggatcagaacggaaaaataaagatctcggtcattccctaccagagctttaccgccattgagataaaggacaacgggatcgggattgccgaagaggaacaggccagtgtgttcctccgtttcttccgttccgagaaggtgaatgataaaaagggagtggggctgggattatatcttgccagagagatcattaccaaacagggaggctatatcagccttcagtcggaggaaggaaagggttcctgtttccgcgttttcctttctgaaagataagaaagatgtgatgcattttttaagaaatttccgtatcttttaagaattcagcccaattctttcaaaactgtcattattctttttttcatggaaagaacatggaaagatttatttgttatagtttagtcagataagaaaaacagatatgcggaggagagaataatgaaaattctgaaaacggaagatcttaaaaaatattacggaaacaaagaaaatgaagttcatgctctgaacggagttaatttttatgtggaggaaggggaattcgtttctatcgtagggacttcgggaagtgggaaatccaccctgcttcatatgctgggaggactggaccggcctacctcgggaaaggtttttgtagacggaaaagatattttcagcctgaaggatgaggcgcttaccattttccggcgcaggaaaatcggttttgtatttcagagctataatctggttccggttctgaatgtatatgaaaatatagtccttcccattgaactggatggaaataaagtggataaggcctatgtgaatgagctgattgaaatcctgggaatcggggagaagcttcagaatcttccgggccagctttcaggaggacagcagcagagagtggccattgcaagagcgcttgcggcaaagcccgctattgtactggcggatgaacctacaggaaatctggattcccggaccagccaggatgtgctggggcttctgaaggtaaccggtgaaaaattcggccagactatcgttatgataacccacaacccggatttggcacagcttgcggatcggattgtcagaattgaagatggaatgattctgaaccggaaggagtgtgaggcaaatgcttaaggtgaaaaacaataagtgtatcagccgtcttgccgataaatccttccgtgcaaataaaacccggaatatcatagctgttattgccatagcccttaccaccattctttttaccgccctgtttaccataggcagcggtgcggtggaatcctttcagtacaataccatgcttcaggcaggggggatggcccatggagccatcaaatttgcaccgccgtccatttatgaggacgtgaaatcccatcccctggtaaaagaaacgggatttcggatggtgactgcggacagcgtagataatccggaatttttgaaacgtcatgtggagatgtattatgaggatcagacctgtatggatttgagctttatctccctgaaggagggaagcataccccagacggaaaatgaaattataatggatgtgccttcccttgatctgctgggtgttcccgccagaacaggagaaaaggtaacgctgcttcttacagtaaagggaaagcaggtggaacgggaatttgtcctttccggctactgggaaccggtcaatccttccatgaatgtgggatttgccatctgttccagggcatatacggaaaaatatgcggatgaactgaaatatatttataatgaggaaccgtatatgagcggatccgttatgtatgatctcatgttcaaaagtatccgcggtatggataaaagtatggatatgctggttcaggatctgggatattccctggatgacagagatgataattatctggcggcaaatgtgaactgggcgtatctgtccaacagcatggggcaggatcctgtgacgatgatggcaatagcggcggccctgggattgatcatccttaccggctatctgatcatctataatattttccagatttccgttatacgtgacatccgtttttatggactgctgaaaactataggaaccacaggaaaacagatcaaaaggatcatccgcagacaggggctgcgtctttccctctatggaatacctataggcctggcagtgggatttttcataggaaaagggattgtgccttatattatggctatcagtaattacaattcgggaaaggtaagtgtttccctgaatcctctcatttttgtgggggcggccctgttttctctttttacggtggctatcagtaccagaaagcccggcaggatggcggcagccatttctcctgtggaggcggtgaaatatacggacagcaatgcagatatccgtaaaaagaacaagaaatccaccgacggcggaaaaatatataaaatggccctctctaatctgggaagaaaccggaaaagaacggtccttgttattgtatccctttccctgagcgtgatcctcatgaacagcgtggtcaccatgacagagagctttgatctggacaaatacctctcaacctttgttgatacggattttcttgcggcccatgcccaatattttaataacaactacagaagcaatgaagtacgtgtttcggaaagtatgattcaggcaattgaagaggagacgggatttgaagaaggaggaaggatctttttttaccagaatatttccgtgaaaatgccggagcccaatcctattcatctgaacgagaatggcgcggcagtaaatgcggaaggagaacacattaatgtagatgagaacctttacccaagagcacaattatatggaatggaggatctccctctttccagaatggatattattgcaggggaaacggacctgaatattttaaaggagaagctggacacagggaattatattattgagggagtggatatagacgattatggtaaggtttatgaagaccgtattcattatgccataggggataaggtgactatccacaacagcgatgggcaggaaaaagaagcggaagtgattgcccagataaaaatcaaatattatacaaacagtgtgcggtactcctctgtggattatgttttttacacaagcagggacggctatgaaaagctgggcggagacatggacagtgtgatgagctatttatttcagtgtgaggatgagaaggaagggcagatggaacagtttcttgcctcctatacggaaaaccaggaacctatgatgtcctttgaatcaaaaaccagatatctggatgatttccagagcctgaaaaggacatttacgctggtgggcggagtcctttccctgataatcgggatcataggggtacttaatttcgtaaatgcatgtattaccagcattattacccggaagaaggaattcgcggcgctgaaggcaatcggcatgacagaaaaacagacccgcaggatggtctgtttggaaggaagttattacgcggcaggagtggttttattcagtctgacggtgggaagtctcttttctctggtagtaatgggaaatttcgtgatattctggtttacgacctaccggtttattctctggcctatgcttatggtacttccctttatggtagtgatgggattagtagtcccttatctgactatcagggttactgacaaggacagcgtggtggaaatgctcagggaagaataatgactgacagaaagggcggaattgattctgctctttctttttttacaggagcgccgtatcagcggagggagtatgtgaaataatatttggaataactttctaaaaaagaatagacaaaaacaggaaaaaagcttataaaggatatattgaggagaatccgttttaaggatattatgaggagaaatttatggaaaagaaaaaggcactgctttgcggcagtgtattagtgttatttgcggctttaatggcttttggatttatgactgcaggagaaaatggctcctttggcggcgatctgcttgaagatgccgtgggtttctgcatgcagtatgtgggagtggcttaattggaatatatacctgcaaaaacaattgtaacaaaggcaaaagcctcccactggttcggaatcgactacaacatgaatatatacaggggctgctgtcatggatgtatttattgtgacagccgttccgattgttacagaattacggatttcgataaggtgagggctaaggaggacgccctgcggataatccgggatgatctgcggcgcaaggtaaaaacaggagtggtcggtaccggcgctatgagtgatccctataatccctttgaaaaaacagaggagctgacaaggcatgccctggaattggtggatgcctttgggttcgggacggcaatcgccacaaaaagtgatctgattacacgggatattgatattctttcggaaataaaggagcattctcccgttctgtgcaagattacggtcaccgcagcggaggattccctctcttccctggtggaaccgggggtatgtccctcctccgcccggtttgaggccgtgagaagactgagtgaagcggggatattcgcaggaatccttctgatgcctgtcctgcctttcctggaggataataaggaaaatataacggctattgtccaaaaagcccatgaggcaggagcaagatttatttatgccgaattcggaatgactctgagggagaatcagcggatctggtattatgataagctgaaggagattttccctgaagaggattatgtttcccggtatcagaaaagatatggctcccgttaccgatgcggcagtcccagggcggcgcagttatggaagctttttcaggcggaatgtgaaaaatacggtatcctgtatgatatgaaaagtattataagggcctataaaagaggttatgaatgtacacagctgagtctgtttgacgggatataagaaaataagctttcagcaaaaaggagaggatagatatggatatcggaataatccagcagaaagcggaagaaatgcggatactgaatcttgcggtaatgaaggatggagaactccttttaaagaaagactgggatgaagaaataagaaggaaccagtattcggcaagcaagagcttcaccagcatcgcagtgggaattgcgcagaaagaaggtcttcttgagctcaatgaaaagctttgtgatattttccgggaggaaatgccggataacccttctgagaatctgtgcagtgccacggtaaaggatttgctgaccatgtgcctgggacaggattcgggttatttaatgggcgtacaaagacctctcatgaaagagatggactgggttcgctatacgctgtcccgtcccttcacacagaagcccggaaccagttttttatataataatgcagggccctatcttgcaggtattcttgttcagagaaggtcgggctgtgatcttgtaaattaccttatgcccaggctttttgaacctctgggaatcagaaggcctgtgtgggaaacggacccttacggatatacctttggggcaggaggtctgtttttatgcgtgactgagcttttgaaattcggacagcttctcctgcaggaaggaaactgggagggaaaacagatagttccttctgcctatatcagggaagcatcaaagaaatatatggataacgagaaggatggctatggttatcttttttggcgcggtccttacaattcttatcgtgcggatggcaaatacgggcagttttccattgttcttccggataaaaatgccgtgattgccatcaatgcggagtccagggatgcggatgcgatgatggaatgctgcatggatattattgtcccgcaattgtaacagatgtaatttatgataataaaaaaggagtaaagaaaatgctttttatagaataccctaaatgctctacctgtcaaaaagccaggaagtggctggatgaaagaaaaataagctatgaagacagacatattgcggagaaaaatcctaccgtggaggaacttacggaatggtatggcagaagcggcctccctcttaagaagttttttaatacaagcggcttaaaatataaggaattgggcctgaaggacaagctgaaggatatgagtgaggaagaacagattaaactgcttgccacagacggaatgctggtgaagcgtcctctgattgttgcggatgattttatcctgacagggttcagggaaaatgagtggaaagaaaaaatggagtgatgatatgaaagaaaacaaatacgatgatccgttattttttgagaaatacagccagatggatcgttccaaaaaagggctggacggtgctggggaatggaagacattggaaaatatgcttcctgattttcagggaaagaaggttcttgatctgggctgcggttatggatggcactgtgaatatgccgctgaccatggagccgcagaagttacgggagtggacatttctgaaaaaatgctggaagaagcccggaaatcccataaaaaaggcaataccacctatatctgctgtcccattgaggatattgattttgaagaggcttcctttgatatcattttaagttccctggcctttcattacattgaaaattatgaagagattgtggataagatccataaattactcaagcccggtggatatcttgttttttctgcagaacatccggtattcactgcggaagggagccaggactggtattatgatgaaaacggaaagattcttcatttcccggtagataattattactatgaaggaaaaagaaatgcggtgttcctgggagaaccggttaccaagtatcacaggacattcaccacatatatttccgttctgttaaagaaagggttccggcttgtggatgtagaggagcctcagccgccggaggaaatgctgaataccgttcccggaatgaaggacgaaatgcgccggcccatgatgtttcttgtatcggcacagaaagaaaaataaagaaaaaaagggtaccttcgccggagggtgccttttttgtaatgcaggcttcgcatatgccatgatgccttccggagatcaaatttttaaaaaagatcccccggaacccgctgttttacgggattgcaacctgtgggtgacaaattgcaatacgctgatttcttgtaaaaaagcagattatatggaaaaatgaagctatagaaaacagagctacattgtggcagacaggagattatatgaaaaaattttgtgataagctgattcagcttcgcagagaaaagggctactcccaggagcagctggcagaatatctggaggtgtcaaggcagtcggtgagtaaatgggaagcagataaaaccatgccggaaataagcaagctgattgcaatatcccagcttttccacgtatcgctggattatcttctgattgacagctgtgaagacagaggagataaaaaatgggagcctgccagtgagacagaggaaatcaggcagactattaatgaagtaaaggattttttaggctatcaaaagggatttgagtataaaagcagggcaaatataggaggtatccctctgatacacattaaattctgccgatatatggggcgaatccggatgaaggatgccgcaaagggaattatagccgtggggaatattgcagttggtgtggtgagcgccggatttgtctcagtggggatcttcagtataggtatgttatctcttggccttctggtttcgctggggattgtttccataggagctttagcaatgggagtggcggctatcggaatcgttgcaggcggcgtatccagtcttgggatttatgccacaggtgttgctgcagcgggcaaggagattgccacaggagtatccgccgcaggtaaaacggctgtggcacagcagggagaacatttatggggccataatatgactgccgtggatgacgaggttaccagggaatgggttaaaagctttcttgttacttataatcccaaagtacccaagtggattcttgattttcttactcttatgtataaataaaacagagaatgtgatatactttttttaacagatgcttgtcagaaatcattttttaaagttgcaattcatggctccattgtaacttttttaaggaggcaggaaatgaaaaagtatattacaatcgataagaaatatcttctgatccctgtttgtgcggaaaaagaactgaagacgatcagcatctcctgccagggagaaaaaatatatgaatttaatgtgccggtaaaggaaaagccggacggacattacggttttcactactatgctcccgttaatatggaagaatataagggaaaaactttattaatagagggaagtattccgaaagcgttcatggatgccatatccctttccgataccgtaccggaaaatctccagtctcatccccttcttcattttgcgccccgcacgggctggatgaatgatcccaacgggctgctgtataaggacggtgtctatcatttatatttccagtacaatccatttgatacccgctgggaaaatatgtgctggggacatgcggtgagtaaggatctgcttcattgggagcagaaggagactgcgctttatccggacagtgacggcgtcatgtattccgggagcggaattgttaatgaacagggacttctgggcctccctgaggatgctcatatctatttttatacttgtgcgggaaataaatcaaaatggagcctggggaaaacctttaatcagagaatcgcttacagtacggacgggggaaatacccttgtaaagctggaaggaaacgcggtaaagcatatttctgaggaaaaccgggatcccaaggtctattggcatgaagagagcaaagcgtatatcatggttttgtatctgaaagacaacgagttcatgattcttcgttccaaggatctgaaaaactggaaaaagagccagattctgactctgaaggattcctgggaatgtccggatctcagaaggattcccgtggaaggcggcggagaaaaatgggtgttctggagcgcggacggttattattttctgggagaatttgacggctatgaatttaagacggatggtgtgaagctggaggcttaccggactaaaattccctatgccgcgcagaccttctggggaacagaggatgtgattacgattccctggctgagaacgaaaaataaaggaaaattatatacgggtgtaatggggattccaaggaaactgatccttgccgaaacacctgagggattgaggctaagacagaatccggttgaggaattccgtaaagcaagggtgagtgtgtcagtttcccagggtgagggaaaagttttttatatgatgcagaaggcaggtgttgttgaaataaccgttcatatgcaaagtccctgcgattttgttgtcaatctctacggtacctccatcacttatatcccttcctgcgggaaaatgaatgtggggaaggaaacggtacagctcgggaaggagctgaatgatttttctattattgcggatggggaaattgtggagattaccgcggacaacgggcttgtctatgccgtatttgagatggaatcggacagtaaatcagggaatgtgacggtggatatcggcggtaaggcttatgtcgatatttacagggtggaatgataataaataaaacgggagcgtatcagtctgaagatttattcatgctggcagctccttttttgttttggatagattgtttgattttgttaagaaattccgttatatctttttaagaaatagcagctatacttgtaagcagaacaaaaggaaatacaaatttgcagataacagctttgtcagaataaaaatatcagaaaggaatttttatgagaattcatttgaatcacttaagcatgacctatcccaccggcaaacaggctttgaaggatataaacctgacgctggaaagtccgagtctcataggcctggtggggcctaacggcgcgggaaaatccacactgatgaagctgcttgttgcagggcttcttcctacaggcggtgatattgccattgatgataagccgctgacgaaatgtgaaaaagagctgaagaagaagctgggctatttgccgcaggacttcggtctgtatgatgaactgacgatatgggaatttctggattatatggcggcgttaaaggggatacgtaacagcaggcccgttatagaagaagctattctggccactggtctggaagaaaagaaaaaggcgcgcataaaaacgctgtccggtggacagcggcagagagtaggaattgcacaggcgctgctgggggaaccggaattcctgatttttgacgagcctactgtgggtctggatccggaagaacgtatccgtttccgtaattttttctctcagacggcacaggataaactggtactgctgtccactcatatcattgaagatatacagtctgtttgtgacaggcttattgtaattgaccacggggagatcctgtttataggcaaacctgaagaattgatcctgcaggccaggggacatgtaggtgttctgctggaacacaacggagataaaaagagtctgacctgcgtatcatctcccgggtgaatacagcggagggtgtgctatgccggggagtggcggatgagctgccaaaggaggcccaaagtgtggagcctacgctggaagatgcctatttatatctcattacgcaggagggtaaaacacaatgaaattttcttctctctttcgtgtggagctgggacggctttttcgcagccggctgacatgggcggtgcttggtattaccgcggcggcgccggcagtgggatttacgttctattgccctctttccggatcgctgaacagtacggctcttgccaatcctgcactgggcggttcactggcaggcgctctgatttttgcattgcttaccgtattggaactggatcgtgttcacagcagccatactgatgtacttacggattccatgatttctcctcttgcagcggaagtatgccggactctggcattgctgacagccgcatctgcagccgctgcggcagcaatgataatctggatgccggtcacggcctcattaaccggcgctgtattccggcccggactttgtgcggcggtatatctgctggtgatgcttccctccctctggttttccatccttttcacagccgctgtttatcagcttgtgcaaagactggatataacattggcagcgttcgttggcttttttctcttaagcctgtcggcctggagagaaaactggctgctgcgctgggtaaatcccgcgctggcctatctttccgatgatttcggcaataaccgcagactcatgtccctgggatggaacaggctgttctggctgttgctgctgggagggatctggtgcctgtgcctgctgtgcacccgccggtacggcagaggagccttcggttccctgcttcgtaatgtgcggatgctttatcttcctgtcatcggaattatgctgactgtaacgggtgtactggtttatggaaagcagccttttttggatcatagtaagaaggaaattgattatgatgcacattataattttgactataatgaacatgtgacctattctgcaatatcggtagatgcgcgtccatccctttttacaggtttttttgaggcaacggcttcctataccctgcataatgattccgggcagccccagaccatttcattctggctgaatcccggctataaggtgaagtctgttacggccggcgggaaatcagttccgttccgtgacctacaaaatgatgatatcaataagaaaacgattgaactggatattcccgccgatgaaaatatggaattatcggtagaatacggaggttttcctcaggagtggaatatattgtctctgcttcagggggagtgtgaaatcagcagagattacatttatctggctcatcaggatttttcacctatgcctcgtgatttctttgaaaatactgcagaacagcctccccttacagccaaaataacgctgcctgatggattgaagccggttttattcagtacagatacggtggaagcggggaagagcgaagccggatctacccaatggatattacatgcttccggatggagtctgattctttatgccggtgattatatctcggagcatattgatgctgccggactgaatgtggaatttttctacagtgccaaacaccggagggttatggaagaatgcaacgtcaatgatacgctgaagcaggtatttgaatattgtacggatcattatgggcctcttttcttctatggtgaggaaggcatgcgccttattgagatcggtgctacgggcggcggttatgctgccggaggggccagtgtgatgggtgaggacagcttcagtgaagcagggcttaaggatcccctgaaaggagccggaggcagtgaagttatggcccatgaaatcattcaccagtggtggggacttggcaacatgatcgaatcttcctatacgggagatccctggtccagcgaagggctgacagtctataccacctatcggatgatgaaagaacttcacggcgcagactatgcacaaaagtattatgtagatgtgtggcagtcccgggcagatgattattatcaggatttttacgtccggaatccgcagtttctgtcagctctgccggaaaagtacaaagccgatatcgccaacagccagtctaccgtccggcagtactgcgaaatgcctctgaaaatactgaaagcggaaaagctggtgggcggagaggaagctatggatcgaatcctggcaggactgtttaccggtgagacgaatccgtcctatccttacctgacctggcaggactttcttcaggcctgtaatcttacagaggaggatttgaatcttgaataaaatatatcaatacgaactgcgcaggatcctgcgcagcaaattcttctggggcctgctggcagtatgcttgttttttggctggaatatactgcagacatccactataaaaggcgttgcacatacagctccgttttctccatggagcttcggggcatatttggcacggattctgcctcttctgggactggcgctgctgttttttctatggaaccagtgcaatgagaaatccaggcagtttgggaggcttaccgatgcggctcctgtagaacagggaaaatatctactggtaaaatgcgctgctgcggttactgcgtggctgctgctggcgctgatcctaacggccctgggtctgggcttcctggtaataatgttcgggagcaatgttcctgtgggaatgcttttgctgacagctgctattactcttttgcctgctcttttgtttctgacaggtatgggacttcttgcaggcaggatacattccagtattctgtttggcttgatggcgcttgcgctgggggcagaatttattcctctgccgatgaattttgatctctatggttattccttttttacggaatatccgttaactacggaactgctggatccggcattttcaatgccgggaggtatgattgtatcaagagttatctttcttttggccgggattggttttcttgtttttgcggtatggcggaagaaaaatataagatgataattacaaagtagaatggtaatagtggaaatgaataaaagcaaatataataattctctgattatagtgattattatatctgcttttatttatcataggaattttatttatattttgtataaataatttgcttttcccacataaagtctgtttagttcataaaataagtcgtttcaggacaaacatggtatattacgttatgctacaataaaacagtagaaattacatgcgcatgaatattaagtataagggggtactatgaaaaaaattttactttctgaaacaaatcctgatgcatatatggaggtatatgcagaaccatcagaaaaggcgaagcctgctgttctgatttatcccggaggaggatactatgcactcagtgacacggaacggcttccaatagttgaattctatagagaaaacggttttcagccatttattatcatgtattctattggaatccatgcacattatcctgatcctctgacagaaggttcaaaagccgtttgggagatccgaaaaaatgccggaaaatactgtgtaaacccggatcaaattactctggtaggattttcagcgggagcccatgctgcaactatgctggcaaatctctggcataaggacatatcaagaaagggaacggatataccggaaggcggcaaccgacctaatgcaacagtgacaggatatacgccaactacctttgaagatttttatataaaatttcctgatgctatgaaactggaactgggaaatcctgaaagtggtccgaagaatttgctgggcgggaaggaaagtggttttgaagagttttcttccatgacaacgataggtatgatatcaaaacttacccctcctgcatttttatggaaaactacggctgattttccggaaagctcattggaatatgctcttgcttgtaaaaagaatggcgtagattatgaacttcatattttcaacgatgattccagatgtgcagcaatggaatttgatcagaaaagagctgtaaattataatccaaattttgaaaaaaatacacaaatgtggccggaaatgtctgtaaactggctgagaaaaatttataatctgtaagttttaaagagagcttatgagggtgaaaaatgaaaaaaaagggtattgtttttgttatggtttttatgatgttatttcttacatcctgtaaaaacggagaaactgaaatatccggaagtacaccgacagaactgcatattgtatattccagttattccgggattccggaagatctggaaatagtacaggatgcattaaataaaatacttatagaaaaaatcaactgtacagtaaatctggaagtgtatcccagttctaattatgatactcagataaatctgttgctgtcaggcggtgacggtattgatttaatgaccagcggattaaatacccgttatcatcaaatagtttctaaaaaacttgttttacccatagatgatttattggagaagtatgggaaaggaataatggatgctgtcggagattctttggaagccggaagaattaacgggattctgtacggagtcaccggagttccgttaactgcagcggcagataccggatttgctgtaaaaaataaaattctgaatgaactggatattaatcttcaggaagtaaaaacaatagaggatgtggaaatagttttaaagaaaataaaagaaaaatatccggatatgacacctcttattccctcttcatcaggaagagcttatgatgatttaagtaactacatgtggcggtctgatgaaatggagtccatagaagacggatgtattgttgattatgaaacaatgacagtcagtaatttatatgaaagcgaaacctttaaaaagacagtggaacttctttacagatggaataaggaaggattaattatgccgaacgcctctactaattccgatacccggggggctttattggatggaaatcagggagtggcctacctgacaacatcttattcacccactctcagtgccaaagaaaatcttcagttggatgttgatatagtagaactggaccagaataagattctggggacatcctcatttacaaatacacaatggatgatacctgtaaaaagtaaacatccggaagaggctatgaagtttttgaatcttctgtatactgatgaagaggtgggaaatatgcttcaatatgggattgaaggggttcattatgtcaaaacagataaggaaaatgtgattacatatccagaaggccaggatgtagtaaacagcagatattatgtgaaaactcccggaattacagatattaatatcaattgttatgcaattgagcctctgcccggagatatttatcaaaaatatcaagaattcaaaaatgaatttaaacagtctcctcttcttggttttatggctgatgtttcagaatgcaaaacagaaacagcagcaatagctaatgtaatagctcaatatcattttaatttcatgtctggtgattatgatacgtctatgctgaacgaaatgaatgaaaagcttaaagatgcaggtattaataaagtaattgaagtaaaacagagacaactgaatgaatggttagaggtaaataaaaatgaaaatcaatgaagttacatttgaatccgtatgtatggcagggaaggtaacatttacattgatgattcccggggagaaaaaggacagctatccggttttgtggattggagggcctgggcatcataaggaatggtttgaacatactcatattgcggaatatgcggataagtatgggatagccgtagtagaagctgacagcagtgagagttggggcggaagagatattgaagaagggcattatttatttgagagttattttaccaaagaattaagagattacgtgatgaaattaattcctatgtctgaagatgtaaaggagcattatattaccggatggtcaagagcaggataccttgctctcaggattgggctggcacatcctgatttatatggaactgttttgtgtaacagcggcggaaatgtggatgcttatggattatacaaagatataggaagtatgtttccgggactgctggaaagaatgtttgatggtatttctacagcaggtgaatttgaaagttcgcccttccatatggagaatatcgtagaaaatatggtaaaaagtaatgccgtatttccgagattgatttttcattgcggaatagatgatcccctggccagaataccgaatgtcagactgagtgaaaaaatgaaggtttggggagtaccacatacgctgtgcatggtagaaggaagccatacatgggaatgtatagatatttccataaagaatgcactggaacttgtaatggatgagaaaaaggagaagagggatgggaaagaataaagaatcttttgttaataagaattatatccttatgataataattaatacattatatactgcggctatgggatttgcgactactcatcttaccgtacatggaactacagaactgggaatgtcaatgacactgtttggaacgattgcatctgcatattctgttttgtgtctggttatgcgtcctatatccggaaatctggtgagtaggatgaatcccaaattgattatgatagtatcattgggggttgcaacattatcttatctggcttttgccatcagcggtaatattccactttttattatggctcgtattatacagggaatcggatttggtatggtgggaacatgtcttccggctttggttgcaaaatccgttccacgggcaagatattcccaggctttgggtatttatatgactataccaatgataacaggtattattacacctaccattatagttgctgcgaaagatgctttaggatacagctttgtatgtgttattgcagccatatgcgcagtagtggctattgtctgcactatgcttttgaaatttgataaggtaaaggaaaatgaaaatacggaaagcataaaaaaggagaaaaagaaatttaaacttaaagaagccattgcaatagaagcctggcctgtagtacttgctaatattttctgtggtatctgttttacagctattatgatgaaccttcttgtatttgatgagaaaattgggttgggtgtatttgccgtatggatgagtctctataatgggtgtaatatgttcacgcgtgctttgggaggaattgttgcggataaaataggcagtaagaaaactttattgatatgtatgctctgcctagctgcgggtcttgcaattttcgcctttacggaaagttatgttctttggcttgccgccgcagtaatttatgctctgggacatggcggattccaggctcctatgatttcggcctgtgtatcctgtgtggaacaggatcgtgctggtgttgccacagggactatgtatatgggagctgatttcggagcgattattgccggtacgattgttggaattcttgtagataatctgggatatcataacatgtatgcggtagctatgggatgtgcagtagcagcatttgttgttttgcttgcttttttccatcccaaggaaacggaagagaatatggaatcagtaaaagaggcagtataagcaaaaggagtattcaaaatgtatgtagaaaacagaatacgatggaaaaaggcggttcctctttttcttatgatgatacctggattgttctatttatgcattaataattatcttcctatgacaggaattcttgtggcttttaaggattatgatcctctgggaggtatttttggaagcaaatggataggatttgaaaattttaaatttttattccattcatccgatactatttacatattgaggaatacgcttctgtataatgtggcttttattattttgaatactcttttttcagttgggatggctgttttacttgcagaaattacgaaccgcctggccgtaaaattttatcagacggcattattgctcccttcactggtgtctacggttattttaagctacatggttttactttttttagacggaaaaacaggttatataaataacacgatactatcttttttaaacagaagtcccgtatcatggtactctgaaccaaaatactggccctttattcttctgtttgttaatacctggcgcagtgcgggaaaaatgagtattatttattatgcaactattattggatttgacagcggtttgtatgaggcggctaatattgatggtgcttctgcatggcagaagatcaagtatataacaatacctcagttgggaccggttattatagtgatgacaacaattgcagtcggacatatatttacagcggattttggactgttttatcaggtgcctctggattcaggtgcgttatacggggtgacaaatgtattggatacttatgtatatcgggctctgatacagcttaatgacgtaggaatgtcttcagcagcaggagtatttcagtccctggtagggttctgtttggttgtaagcacaaatatacttcttagaaaaaagagtccggaaaatgcattgttttaggagaaagtatatattatgattaaaaatggaaaaatgactttattgattcatatggtactgactcttttcactattttggctgttttgccttttatattaatgtttatgtcttctattacagatgaaagcatgatttttcagaatggatatagttttataccagataaattatcagcagatgcttatcgttatgttttggtgaatttgggacagataggaagggcatacggcgttactgtttttataactgtttcaggaactgctgtaaatcttttgattactgctatgctggcatattctttatccaggccttttcttccctgcagaagtttttttaatctgcttgtagttcttactttgctttttaacgggggacttgtacctacatatctggtttatacacagatattccatataaaaaatacagtatgggcattactgcttcctaatcttctcatgagtccctttcatgttattctggcaaaaacctattttataaacagcataccatctgaaatcatggatgcagctacaattgacggagcgggagaaattcgtatttttttcaggctggttttgcctttggcaaagccaatgatagtaacaataggtttattttcaggtatagcttattggaacgactggatgaacagcttatattatattactaatgtcagattaattggtatacagagttatttgaaccgcattttaagtgatttgcagtatctgcagtctaatgaagctgcagcatccatgtcaggagatatatcgtttccgggtatgagtataagaatggctattgccactatggcaatattgccgattgtcattttatttaccatattccaaaagcattttgtcagaggaattgctatgggtgctttaaaagggtgagggcattaaagaaaggtatgatggtatgaacctgctggttgtggatgatgagatatatgcaattgaaggaatcaggcttttgctggattggaaaaagaatggaattgataatatatttgatgccgccagtatagcggaagccaaggatattttcagcagggaaaaaatagatatgctgctttgtgatatagaattggtagaggagaatggtctcgatttattggtatggatgaatgaacagggatataggacaaagacggtatttctgacttgtcatgaagttttcggttatgcacaaaaagcattgcagcagggggctgtcaattatattcttaaacctgcaagacctgaacagatgatacaggttattaatcaagttaaagaattgctggaaaaagaagaagaagatcctgtggtagggctgattaagagctatattcctgaaaaaacagaaaaaagtgattttctgaaacatctggatagctttttattggagaatatagaaggcgatttgagccggaacaggatagcctcggagatgtatttgaatgcggattatatggggcgtctgctgaaaaaagaaacagggctttccttaagtgaatatataggaaagaaaaaggtgacagttgcttctattttactccatacaacaacaatgcctataatagatgtagcccagaaagtgggtatccaggaactttcatatttcttccggctttttaaaaaggagacgggacttactccaaaagaattccgtaaaacatataccggtaaaggtgattattgcaatgcagaggaaagaagaaaagaaaaagctcagaagtaaaattacaacccggacattattaatcaccttatctctgtttgtcatgcttattatgcttgcatgtattcttctctatggaagttaccatatgaatgtactgagccggcagatattggacagtgcaaaaacgtctctgagtgtggctcagaacatgctggatatcagtcttgaaaaaaatgcccaaatgataaatattctgctcagtgataatggatacatttattatccggaggaaattaagaaagagaaggagatcgtatataaatatactcaactatataatcactgcgctaaatatacggctcagctggaattatgtgacggcgtatttgtatatgacagttattttgatcgatgggcggtatcaggcagttcagatagtatttttctgcaaaatggtataagagaattggttaatgcttataaggataaattggatgcgccctggataatggcagaagttgaaaataaggaatgcctgatacatattcagaaaaattctgatattattataggcttttgggtaagcacggattctttaaagaagataacggatatggagcttactgcttatggcgagaatgcccatctgttagttgagtcatataaaaagacagatgaggaaaacaaagatttttcagataaggaatatttggaggtttttgctgtttcacgtctgcatgcctttcagcttcatgctttaatacccaaggatgatatttataaaaatgtatccgtacttaaatggatgcttgtacttattagttttatttttttacttttgatcgctgcacaatatgtcactacaaatcattatgttttaaagcctcttcagttattgaaggaagctatgatccgtataaagaacggggatttatcttcacggcttaatccatcatctgtaaatcctgattttggggaagtttatgaagcgcttaataatatgagtgacgagctgacaaaactgaaaattgatgtttatgaagaaagaattaaaaaacaaaaattcgaactggaatttctgagaatgcagattaagcctcacttctttcttaattgtctgaatatcatatatagtctggtaaatgcaggaagatattctttgatccagactatggtagtaaggttatcggattattttcgttatatattcagaacaacagacagctttgtaaacgtggaaaaggaactggagcatgttgaaaattatctgcagattcaggcagtacggtatccggatcggtttacatataaaatcaggagagatacagacacaaaaaatataataattccacctatgatgatacagacatttgttgaaaattcaattaaatatggtttttctaatcctatcagggatcaactgaaaataggaatccgtgtattggaggaagaagagatatattccataactatcagagataatggtaaaggctttcctccggaagtcctaaaaaagctgcaggagaaaagttctttggaagatgagaacggaaatcatatcggaattcaaaatacattaaaaaggttggaattactttatcaaaacagagcgatagtagaattcgaaaatgaggaaggggcacaagttcatatttatcttcccaaacatcaggttgaaaagctgttgtaagctttagaaaggggtttttatggcatcaattatatgtacattctattctaagatattggcaaagacaactacagcgcaggtatttctgccctccttcagcgggaaagaggcttttagcctgtcagatgatgagagattccatacggacagaaaatttaagacgcttgtactgcttcatggttattccgaaagctataatgcatggcagagatattcacaaatggaattatttggagaggataatggaattgcgattatatgtccggatggtaataatggtcattatacggattgggaaacaggtcctcaatatcttacttttttaaatgatgaatttctgcctgccatgagggccatgtttccactcagcgataaaagacaagatacttttgtgggaggtctgtcgatgggaggatatggggctttaaaatgggcatttacatatccgcagacattctcacatcttcttaatttttcgggaggagtagatattgtggatcgtattgcgtactataaggaacgtccggagactgcaaagacaatggaaaccgtatatggtaatctggataaggtaaaagacagcaagcatgataattattggctcctgaaaaattatgatacggatcaatatcctcttccccgtcttttttccagctgcggaacagaagacggacctgtattcggagtacacagaaaactggtggaaatgtacagggagttaggaggagatgtaacagtatttgaatgtgagggagtacatgattttcatttctggaataaagcattggaaagggcaatgtatacatggcttccaaatgaaagagaaaaatataacaaagaataatatattattaaagagggagctgaaaaagctccctttttaattgaaaatccggtataagtgataggatcctaccaggtggatatttttataactagaacttatagcttgcagcatttacaaaggaagtatcatcatcttcctgtacttcttcgtctttataatcctcaaataaagcaacatccgcagatacaagctccactgcatttctgatttcaggagaacacctcacaacagcaatatcctcaagacggagccggctgcggatgagttccggaggaacatcttccgaaatttcagctacggcgcaatcaacgacatgcagtccgcccggcgtctgctcaagcagctgtttatcaattcttatattacttctgtcagagatcatggtacctttaatgacaaatatacttccgtattccacaggaaattccgataaattcctgctgtacttttccggtatataaagggtgccggtaaccttcagatattccagttcggggagtgcttccatggactgatccgtcagcgtgagatctccgtttttatagagcttttttccaaacaggctgactgtcccggaatctaactcggtattatcaggaagtatccggcattcatcgggtataatctggatttccgtgtgctcatcaaataaagacaggctctgttcaaacagacattccattaccatggcttttttacataaaaaagttacgttttttcgaattaatgcggctagatcgagggacgcgtccagcagctttaccataccattgatgaaatatggggtatcctggcgggcccggagaataaaatatttgtcgacgtcaacatccttcagcaggcatatggcgttatcaggatagcttttttgtgtaccgtttacctgaatttttgatacggcatcagaaagtccttcaggatagatgagtgatccgtttaccattattttttcatagctttccaaagcttttccggcagccggatggataaaaagacttcctgaaacaaacaggaatgaatgctcagccgcaaaggctttttcatttatttcaatggaaccattttttattattaaattgattccttcgggaaccttaattacgcaggctgtatttatttccacaggatatttggagataaggacggctgatttttcagactggatcactgcagcggcattaattgcaatggcagaatactgcgacagcctttcctcggtaatttcagtcatatcacaaagagccgtatttactgacagttttttcgttttttccataattgcacctcttattttttttgattttccagttcggggtaatacatgcgcagcttccgcctggcgctggcaaggcgtgagcgaatggtggagggcggcagcttgtacatggcggacagctgtgtggagtcaaaaccctcaaagtatctttttatgaatagaatccgttcttcttccggtaatttttcacacagctgccggacttcaatctgggacaaatcgtcctgtgtttccgttttttcttctgcttccgggtatgccgactctcgtctcactttatcaataaaaatgttgcgggatgttttatacagccatgaccggcattgacgttcatccatgtcatccaggatttccgcgtgctccatggcgcgaaggaaggtttcctgcacaatgtcttccgccgcggttttgtcgcaggtcattttggtgacatatcgaatcagttcctgaaaaaacagctgataaattttggctatcataggagtctcctgactgcgtttgctgttgtattaatatcattgtaacttatgtcagagaaaaaatggtaagttttttaaaatggccaggaaacacagcaaagatacaggaaggtaatgatgttttcttttcttgaaattcatatccctgatttctgtattccttctgctgtgttcggcctgccgggcagaagtaaaaaggtagtattcataaaatagttcaggattcatatccgccgctcctttcacataatggctcgttttgatcggttacatctatataacgaatgggaagggagaagtgttgatgtaaaatctaaattttgaaaaattagtggaatagacagaaagtcctggaatggatcccgattgcacagggaaaaagcataggccataaaaggatcataccgatcggacatttacggggatatgctttcagggtcagaattttgaaatcattcgatggtgctgttttgaagagtttccgtattttcggaaagaaagtgccgatggaatatcatgaacatatgaatgtatagccttcattcatttctgtctgattctccatgccattcctctaatgcatcaagaacaccttctttaacggccttttttataataaaaaataaaaagcctcctattactgcggcgattaaaagataaatcaagatagtatataaaactgcaactattgacatatctgtttcctcctttgttaaaaatgagaattcttgtattttatatctaagtgaaattataaaggaaaaccattgaaaaatatacgtttttagagaaaaataagaattatttaagattacttttcagagacttccgctataatataaaaggttccgaagccggtacggcattgcatggatattgcagcactgctttaccggctgataacagacgacaataaatctgagaggtatgaacatggagaagaaacaatacatatgtcccaaatgcggctgccagcagtatgaaagtgatcagtttcaggccacaggaggaaattttgccaagatttttgatgtgcagaataagaaattcataacaataagctgccgtcagtgcggttataccgagctttataaaggacagggttccgacggatgggatattctggatttccttatcggtaactgaaagtaagtatccgataaataaagaggccgtcagtatgaaaagagacaggaggtgtatgctgtttcagatcatgctgacggcttcttgtgccttctgcacaaaatttcatgttcagcggccatatttacattttcttatatgcaggctagtatttcattaaataaacagaaaaaagaaacggcaacggcgcttaaatgaattcatttaggcgtcattttttatttcatgaggagaaagcatatgataaaaaaagttatggcaatggttctcatacttacgctggctgtttctatgacagcctgcggaaacagcaatatcacagcggcaggagcagaaagcagagagaaaattacgctgggaatcaatgactggccgggaagctactggtggctggcagttgataagttaggatattttaaggaacagggcgtagatgtggaggtacagcttttctcaaattatacggatggattaaatgccttgatgtccggaaaaattgatatgttcgttccggctcttgcagatataattcctggatatgtaaacggggcggatatcaaggttattatggtgcaggatttctcagcaggtgcggatggcctggttgcatccccaagtatctcatcagtagaagagctgaagggcagaaatattgcaattgaattcggcgggagtgaccatttatttcttctgaaggctcttgaaaatgcaggcttaagcgaaaaggatgtcaatcttgtcaatatgtcaacaggagatgcctctaatgcttttatagcagggcaggtggacgcggcggcagtctgggagccatctttatccatggcgcagcaggaaaccggaggaaatattctggcgacctcaggagataaagaatttgagggcttaataccggctattctggcagtaaatggtgattcactcaagacaaagagggaagaaatgaaatccgtaatgaaggcatggtacagtgcaagagatgcctatgataaagaaccggataaatttgcggaagcggttgcaggcggagcggaagtgacggcagaggaatttctggaattgatgaagggctgcgatgtcaggactatggaggacaatgcggaagcctttgcagccggagatacctatgtgagtttaccatactgtgccaagatgctggccggatttttacaatacaatggtttgatcgattctatgccggataattttaatgatttgtttgacagctctttatttgaagaagtttatgaagaaatgaaataacaggtcgaagcggaaaggctggtggaaggatgcagaaaataaaaaagattgtagatttatctcatgaactaaaaaacggtaccgtggtgtatcccggagatcctgttgtggatattacggtggcaactttaaaagaaaaagacgggtataacctgtcaaatgtacatataggatcccagtccggttcccatgtagatgctccctatcatttcaaaaatgatggattaaccgtagatcggatggaactcagttactttatggggaatgcccttgtcatagatgcatctgataaaggagagtttgaggagattacactggaagatgtaaaaaagtatgacagacagatggaaaaagcagatattgtgctgtttcggacagactggtatcaatatgaggggcatgataaatttttcagacacccttatttatcggcggaggcaggagcctatctgctgaatcggggaattcagacattggccatagataccatcaatctggacagaaccggcggaactaaatttccggtacatgagatgtatgcggaagcaggcggtctgatcgcggagaatctggcacattttgataagatagaatttgatgaaccatttgttatctttctgccgttaaagctgacgggagtggatggttccccggttcgggcagcagcagtttcatttgaatgaggaggttacaaaaaatggaatacgaggtacagaaacatttgcactatggaggcattcccagctttaatgcctatcccgtcacaagagagctgaaaaatgcagatatagcggttatgggagtgccctttgacagcggagtcaccaatcgtccgggagcaagactggggccgcgtgctatccggaatatgagccagcttgcatgctgcttttcctatccatggaattacaaaataagtgaaaaagccaatattatcgattatggagatgtgggctattatgtaggtccgaagacaacagaggtcatgctggaggagactcacgatcatgcaaagaagattttagatgcgggctgtaagctgctgacactcggcggcgatcataccattccctatggcatggtgagggcggcgagcgaaaaatatggcagactcgcgcttctgcattttgattcacaccaggatagtacgccaagtaccgatggaaatgtgtcccatgctaattttgcttacgatttgcaggcggagggctgtattgatccaaagcattccgcccaggtgtttatccgaacggaaatgacggaatgcggctatcatattttctacgctcaggaggctgtatttatggatatggaaacgctggcggagaaaataaaggcaattataggggatatgccggtctatcttacctttgacattgatgcgttagacccttcggcagcgcctggaaccggtactcctgtcattggcggcccttctgcagcacaggtgaggaagcttctttatttattaaaggggattcatgttgtggcagcagatttggtagaggtgctgccggcgtatgatcagagtgagattacggcgttggcagctgcagctatagcacaggatttaatgtatctgatggattagtcatcgaagaatgggaggctattatgaaaaagaaaattgtgagtttggcattggcagtggtattggcactatctctttgtgcatgcacaaatcaggaaacaggaaacaccgcggcagcagcggatacatcaactgcggcaggcagcagtgctgcgtccgaagaaaatacctcaaaggaactgacaaagctgtcgttgggaacctctccgtggcccactaacatgttcttttatctggcaaaggagaaaggaatttttgaaaagaatggtattgatgtgactattcaggaatttgcgtcaacaacggaaagctccaatgccttcgtcggcgggcagatagatttctgtacctatgcctcatccgaaacaattgcgccgtttgctcagggagcggagttttccgtcgtactggaaacggataaatcgaacggctgtgagggactggttgcaacctctgatatcaagaatattactgacttaaagggaaaaacgatagcaacccagctgtatagtgtggatcacatgttcctgcttaccttattggaagaaaacggaatgagtgagaaggacatcaagatagtggatatgtccatacaggaatcaggcaacgctttcgtagcaggccagtgtgatgcggcatgtatctgggatccctatttttcacaggcaaaggaagccggaggtacagaactgttttcttcagcggataacccggatttgattacggatgtattgcttgcatcaaagtcactctgcacggaaaatcccgatgccgtaaccgcagtcattaaaagctattttgatgccgttgcttactggaaagataatcccgacgaagccaatgcttatatgggagaaaagctgggagtggatgcggaggaatttgcaagtgagatgaatggccttcttctcccggatgcaaagcaggttgtggaagcctttacggaagcggatgattttacttactggggctatacacagaatacggtcagagattttatgtacgaattgggtgtattggataacaaagacttcaactgcggggatatgatcgatgtaagctttgtagaaaagcttgcagaatagcaataactggataattataggtttttcttgacctgttttccgaaaagtggtacaaataaggaaaataaagaaaaaccaaaggcggttttaccatcaggtagaatcgcctttttgtgttgattggatgatgatatgaactgtgaagatttaatgaatatggaatccatccgaaaaggaatgaagctgattgcaggcgaaaaaggaatagaccgtaccatacgctggatatattttgcggattgtgtccagtgtctttctgctgattttaatgtggcggaactgatacatggggaagagctggttatcattacaaatgagagtctgacagagaatgacagcaggctcattgatatgatacgcgtcatgcaggaaaagaacattgccgcgctggctgttaatgaaggacagatatcaaaaggcctggcctcgtactgcaatgaggtggaattgccattatttgaactttcggtcagccttcatctgattgatttgtctcaaatagtgtgtaaggctttggtggaggaagagagctttaccaattccagggagagaatactgtccaccatcctttattcggataacctgaatgtggaagaactgctggagcaggcaaattatctcggaatcaatctttccggaaaataccgctgcttcctgctgcagctgcatcagagagaaaagctgcccaatgataccagccgcatggatgaaggctatatgatggaaatgcggggaaatatcaagaaaatggttaaaaaggaattccgttcccacgggctggaacggctgatggtattgccgcagctggattcagtcatcgggctgattccgggagaatttttcagccatgatctgctgcagattattctggagaaaattatcggcagggtggaaagcagctatcatattgatgtgaaagcaggcatcggaacaagctatgaatatattgaagattttaggaagagctatcaggaggcaaaaaatacgctggcaatatccaaaatttctgctgatgaaaaaaaggtgtatttctatgaaaagctgggtatttattctctgattgcccagatatcaaacggaaaattcctggatgattatgtggaaagcaggatcggtgagctgataaaagcggatcagatgcaggaaggcggtttgtgtgagacacttgagacctatcttgcccataactgtaatgcaaacgccgcagccgagtatttgtttatccaccggaataccatgcgctaccggatggataaaatcaagaggattctggatgatgacatcaatgatatggaggtttttctggaattaaagcttgcctttgcgatcaaacgctacagggaaaacagggcggcagatgacagctccggggcagtaaggtaacattgtgcgcagcgcacaagaatgattatgaaggagttccattgtaaatataaatagggaaacatataataggctcataaataaaatatttttatgggcgaaggcgtcgggatatgaattccggcgtcttttattttggctgaaaggaaggcagagaagtatgaagatgataaaagcggtggtcaggccggaaaaatgtgatcaggtgttaaatgagctttgtggggcaggctacagggcggtaacgaggtttggaatattaggaagagggaaacagcgcggtctgaaggtagaagacgtttattatgatgaaatccctaaggaaatgctgatgcttgtggtggaggatggggatgtgaaaaaggcgacggatatcataattaaattttcgagaacaagtgatgagggttcctttggagacggaaagattttcattctgccggttgagaaagcaattactgtaagctccggtaaaaatgaattataggaggcgtgtatgaagcaggtaatgattatagtaaggccgggctgttattttaagacaaagcaggcactcagcgataaccgcttctttgctatgagtacgaaggaggttctggggcgcgggaaagcgtttgtccattttacttcaggagagggtaaggaaacctctgcggtaaatgaggtatatgagaacgctcttgtcgccaaaaaattaattgaaatggtggtgccggatgaagcggtggattcgctgatacagcttgtgctttccgtaaacagccatgggacggagggcgacggcaagatatttgttcttccggttgaggaaagtatccgtattcatacgggtgagacaggggaagatgcactggtataagaggaagggcatgattttatatgaaaagagataaaggagatttccggttaagaaaagaaatatcgcagagacggtttatcctttcggcaatactgacctttataattatttttgcaggctggtgggcgctgtgtgcgagcgggaatgtcagggagctgtttcttccgtcgccgataaaggtcatcggagatattgcggcaggggcaaagaacggttcgctttgggtaaatatgggatatagtattttccgaattaccatgggctttttattatccgttgctattggggtccctctgggaatactggcagggagcttcaaaccgttagaagccattattgctcccatctgtgagtttatccgttatatgccggtgcctgcgtttgtaccgctggtcatggtgtggtgcggaatcggagaggcggctaagatcacgattgtatttctgggatgttttttccagctggtgctgatgatcgcggatgatgcgagaagtgtgtcggatgatcttctttcctcgagctatacgctgggaacaacgagatggaccacggttactaaggtgctgattcctgcaatggcgcctaaaatgatgctgacgctgagaatgatgatcggatggggctggacctatctgaccgttgcggagctggtggcatcaagctcggggcttggatattccatattaaaggcacagagatttttacatacggaaagtattttttcaggtattcttgtgatcgggattttaggactgattacagaccgattatttgcattcgcaatcaaaaaaatgttcccatgggctgagtaaaaaggagacggtatggcaggaaagaaaatagaaaacaatacggcaggctctccgcttgaggcacatgtggccagcagtaagattcgtgcggagcatatagataaggtatacaaaaccggaaaaaagagtgttgcggcaattgaggatgtatcaatcgatattcaggataatgattttgtctgtatcgtaggtccgtcgggctgcggtaaatccacattgctcaggatgctggcggggctggattttcccagtgcgggcaatattattgtcaatgacagaaaagtgaccggtcccggcccggacagagggatggtgttccagacttatactttgtttccgtggatgaatgtggaggataatattaagttcggcctgaaaataaagaagctgccgaagggggagcagcaggaaattgcggatcgttacctgaaaattataggtctggaaaagtttgcgaagtcctattccaaggagctgtccggcggaatgaagcagagggtggccatcgcgagagcattggctaaccagccggaggtgcttttgatggatgagccgtttggagccctcgatcctcataccaagtccatgatgcagcttctgatgcgggaaatatgggtgaaggagcatcccacagtggtgttcatcacccatgatattgatgaggcggtttttctggcagataagatctatgtgatgtctgcgaggccgggaaaaatgattaaaagggttaatgtctatctgccccataagcggacgctggatttaaaggattcaccggaattcattaaaatcagaaaagggattaatgatctgctgtatatggcaaatacggaggaagacatggaataaacggaaaggaaagcaaatgagcatcagcaggatggtatacaccggcacctcttatttcggggaatatgccagagaaaaaattgcggaagaggtaagcaaacgtcatttcaggaaggccttgctgatatccgataaggcgctggaagcatgcggcataaccggtaaaatagaagaagtgttaaagaaaaacgggataccttatacactgtttgacgaggtgaagccaaatcctgccattgaaaatgtcagggcagggcttgcctgctataaaaacagcggaagtgattttattcttgctgtcggtggcggttccgttatcgatacggcaaaagcggtggctgtgacagcgaataatccggaaaatgaggatattgtttcactggaaggaatggataaaagtaaaaatccggcggtgccgttgattgcagttcccaccacagcaggaaccggctcggaaacgaccatggattatgttattaccaacacgcaggaaaagcggaaaatggcgtgcatggactcgaaagtggtgcctgcggcggcaattctggacacggagatcatggcatcccttcctctttcccttacggcggcaacagcaatggatgccctgacacacgcagtggaatcctatctttcaaaaggggcattctctttttctgaaatgctgtcgctgaaagcggtaagcctgatatcggagaattttatcagggtggtaaaggaaccgggaaattatgaggtgcggaaggagcttgcgatcgcccagtatcttgccggtatgagttttacgaatgtcgggttgggaattgtacattccatggctcatccgctgagcgcattttatgatatcccgcatggaacggcgaacgcgctgattcttccccatgttctggaatttaatgcggcagcctgtcctgaaaaaataagacagcttgcggcagccttcgatccttccttcgatacatcgaagagcgcggaggaggcatcggcgcattgtgtggagatcatccggagctttctgaccgcttccgggctgccgcagcatttgtatgaactcggcgtcagggaatcggattttgaagcgcttgcgcagtctgcctgtgaagatgcggctacgccggataatccgcgcgaagcggacgagaatacaataaagcagctttatcagagtatgtataaataagataattagcgacagaggcgcagaaaagaggaaaaagatgttaagagatgcgttgcctgagattattacggagaaagtgccggggccaaaggcggaggcactgttaaagaaacggaatgccgcattgccgaaggctttatgcacagccacctatccgatctgcataagcagaggagaaggcgcggtgctggaggatgtggacggaaataaattcctggattttataggaggggtgggcgtgctgaatatcggctattcccggccggagatcatagaagcggtaaaggaacaggcagaaaaatatttccactgcatctttaatgtggtggcgcatgaaggatatattgaactggcggaaaaattcaatgagctgatgccctgccgcggtgaaaggaaaaagacatttttcgccaacagcggcgcagaggcggatgaaaatgcggttaaagtggcaaaagcgtataccggaaggaagggcattatctgcttttcaggggcatttcacgggagaaccaatctgacaatggcgctgactgcaaaaaaatcctatgcgcttggcatgggcccgtttccgtcggatatttaccgggcggaattcccgtatctgtaccgtgctcccaaaggttattcagaggatgaggcgatttcctattatattgaaaagttgtccagactattcgatgagtcggcgccggcttccgacgtggcggctgttttggttgaacccattcagggagagggaggctttatcccggccccgattccatgggtgaaggcgatccggcagatatgtgatgaaaatggaattcttctgattgcggatgaggtacagtgcggaaactgcagaagcggccgttattttgcatcggagtactggaaagaggccggcgcggctccggatattattgccacggcaaagtccatgggcgcaggtctgccaatcagtgcgatcacggcgagtgcggagattatggacagtgtgccggcggggacaatcggcggaacctactgcggcaatcctctcgcatgcgcgtcggcattaaaggccatggagatcatgaagcgggaggactatgcgggtaaagcacgggcaatcggaaaaaaggtgacagagcgttacctggattttaaggcaaaatatgaagaggccggtgatgtacgcggtcttggagcgatgataggtatcgaatttgtgaagacgaaggagggaaaggaaccctatcctgagtttgccgcaaaggtgattcagacagcgctgcaaaagggccttatgctggaaaatgcgggaacctacgggaatgtcattcgttttcttgctccgctgtgtatcacagacagccagcttgcaagagggcttgatatctttgaagaagccattaccgaggcaaaaaatagttgcagataaggggatttgacggatggaatttcaatataacctgccggttaatctgatattcggcagggggagtgtcagcagaataggagatattgccgtagattatggaagcagggcatgtattgttacgggccgcagcagtacaaaaaaatcaggtctgctgaatcgggtagccgaatatttagaaaaagcgggagtggaaagtgttgtttttgacagggtggagcagaatccgctgaccacaacggcaatggaagccgctgcatttatcagacaggaaaaatgcgataccgtcattggccttggcggcggaagtatcatggattgtgcgaaggcggcggcatttttaagtgtgaatgacggagacatcaatgattacatattcggacggagaaagagcagccttgctctgccgattatcctggttccgacgacctgcgggaccggaagcgagggtaacggttttgcggtgctgacaaacccgcttaacggcgataaaaaatccctgcgctgcaacgctattgtcgcaaaagcttccattatagattcggaatgtatgatgaccatgccgaaaagtattctggcaagcgtgggttttgacgcgttctgtcattgtatggaagcatttatcagtaaaatcgggcagccgctcaccgatatgatgagcctgcaggggatgaagcttatcggaaaatatctggtgcccctctacgagggacagagcagcctggaggcgtgggatgccctgagctgggcgagtacactgggaggaatggtcatccattcggcgggtgtgaccctgccacatggaatggagcatcctgccagcgggcttcgcaatatcgtgcatggcaggggcctggcggcgctgacaccggtaattatggaggaaacaatcagctgctgtgcggaggaagacaggaaaaaattcgctgagatctcccggtgtatcggcggcacagatgagacggactgtgcggcagagatccgcgggcttctggatcggctgcagctgtcggaaacactgacagggctgggcatacgggaagaggatgtggactggatgacagaaaactgtataaaagtatctgcggccggaatttcctgccatcccgtcagtttcagcagatctcagatcagggagctgtatcgcagagcattgtaaaagcagggcagttcagatttatctggattgtcatgcagaagcagaggaacagagggatacttatggagcataagaaaacatttattaacggagaatggatggacggcacctccggcaggattcttcagtccgtcaatccgtcaaccggcgaagtgattgcagaagtaagggagaacagtatttctgatgtgaaggcggctgttaccgcagcgaaaacagcgttttatgaagaacggacatggcgggatatggatgtacagacgaggagtgacattctgctacgcattgcatcactggtggaggaaaatctggagaatatcgcggaaaccgaagcgatggataatggaaaacctcttcgggaagcggaagcggacgtggatgatgcggttcactgtttccgatattatgccgggctgatccgtacgccgaaggaaggtgtttatgaggtcaacagcaatttcggaaggatgcattccatggaagtacgggaacccataggagtatgtgcactcatcacgccgtggaactttccgtttcttatgggagtctggaagctggcgccggcactggcggcgggaaactgcatcattttcaaacccagctcggaaacagtattatccactatacagatgtttgaaatctttgaaaaagcagggctgccgagagggacggtaaatctggtcataggaccgggcggaagtatcggaaattttctggcagagagcgcggatgtggatatggtgacttttaccggaagtacggcggttggacagagtattatgcgggcggcggcgggaaatgtcaagaagcttggcctggagctgggcgggaaatcccccaacattatttttgcggatacggatttggatgcggctgtggaatgggctatgctgggaatctttttcaatcagggagaagtgtgctgcgccggttccaggattattatcgagcgttccgtgaaagatgtatttgtcagacgctttgcagaacgcgcggaaaggatgacgcttgggaatgcactggataatccggatatggggccgttagtatcggaaaagcatatgaatgacgtcctgtcttatattgaacttggaaagcaggagggcgccaggctggtatgcggcggaacaaggtatacggaagggaaatgtgcggacggatattttgtaaaaccggcgatcttcgatggatgtacggcagatatgagaatagtccgggaggagattttcggcccggtggcaacgattcagatcttcgaaacggaggaggaggcagtccggcttgcaaatgatacggtatatggcctggcaggcgccgtatttaccaacgatgcagcaagggcgatccgcgtcatcaaagagatccgcgcgggaattacctggattaactgctataacccggcattcaccgagggtccctggggcggttataaaatgagcgggatcgggcgggaactgggaacccatggacttgaggagtatcaggaaatcaagcagattaacatgaacctgactccgggggagccaggatggtatcagaaacggtaacagggtttatttcctgcggaaaaagatacgcaggagcagacagataaaaagaacgccagctatgcagaatcccacaaatgcaggccagggaatccccagaagaaggggtttcacaggagccaggcataaaagagaggatccgataaataaggaggccgtcagtatggaaagagacagaaagtgtacgctgttttggaacatgccgccggcttcttccacatttgtaagctccaggttcagcttggtctgtccgtttttggtgatgctgagtaaatcggacagctgggcaggaatttccagggatttggcaagggaagaataggccaggcgcgcgttatgcttcagctcgtggcggagatcaaaatcgtcaaggagtatggaggtcatatgcccggaaaggatctggaacatatttacctccggagaacaggcggagagcatgccttccatagtcaccatgctccggcccaggagagtgatatcgggcggaatggcaatattgtgggattttatcatatccagaagcttttcaatcaaatcccccacatccatgtttccgaagccggtggtaaggaatttgcttacaatatcgtctatatccgtgtataaacgggcatgattaatacgccctttggcatccccgagggcgagaagcacgttttttaaatcatagatgtcatttttcaggactgcggataccgctcgtttaaagagagcgcggtaacgggaggaaagggttcccatcatacccaaatccagccaggcgatctgcccgccggaaatacggatattgccgggatggggatccgcatggaaaaaaccgtcttccagtatctgcttacagtaattttctgcggccttccggccgatttccgtcatatcatagccctgctcttccagttccccgatgtggtcaatctgaattccctctatataactcataaccataatgtgggaggtggtcagttcatggtaaaccttagggcaggtcacatacttaatttccttatgattttcccaaaaggtatcacagtttgcggcttccttcagaaaatccatttcctcctgggaggtcttccacagttcatcaataaccgttcggaaatcgatgagttcccctgtccccatggtaaatttaaggagagaaaccgcgcgtcgcatcagtttgatgtcttcctccatgatttcatggatctgtggcctctgaaccttgataacgacctgatctccgttgctgaggaccgccggatgcacctgggcgatggacgcggaacccagcggttcaggggaaatttctttaaaaaatacatccgcaggctttccaagttccttttctatttctgatttgatgacatcaaaaggaaggggcttcacatcggttcttaaccgttcaagctccttacaataagactccggcagcatatcggaacgcatggacataatctggcccagtttcacataggtagggcccaggtcctccaatatctgccggagtttctccggttgaataccggacgtaatatgatgctttttcagaacccccagtatctctttaaggcggataccggaggcgtcattttgctgcttgttatttgttgtcacaattttccccgtcacaggtttcggttttttcttcacaagagcattcttcttcacagccgcagtcttctttggcttcttcttcctctgcaggagcggcatccttaagtgattccagcttctccttcagggcttccagctcttccctggacatcttgtccaccgcagaaaaaacatccttgaattcatttaccacatttacggttacatgcttattgatcttttctttggtattgcgtttgagctcttcattgagaaccttgccctgctcaacggtcagctctcctttttccaccagattgtcgatcaggtttttagcggcttcgccggtggtggctacggcgccaacgcctgccaaaaatatttttttgattccttctgtaatgtccatttttctatttcctttctttaaaaaaaagaggggttattttgtgatacccatagtataacatattgtcagaaaatatcttgagtttcagaaaggatttagaaaaaattaagattatgataagggttcccattttttataaaaactgttagaataaatctaaaagatcagctgcatttagctgtataatgaggaaaggcgaacatatatgaaaaaatttgatgtaacggcattaggcgaacttttaattgactttacagataatggaaaaagcgcacagggaaatactctttttgaagcaaatccgggaggagcgccctgcaatgtcctggcgatgctgaacaaatgcggacatcctaccgctttcatcggtaaggtgggaaaggatatcttcggcctgaaactgaagtctaccctggaggaggtggggatcaatacctccaatcttattgtggacgaaaatgcaaggacaaccctcgcttttgtacagacctttgaggatggtgacagggatttctctttcttccggaatcccggagcggacatgctgctcacggcacaggaagtggatgaggaactgataagggattccaggatattccacttcggcacgctcagcatgacccatgacggggtgagggaagcgaccaagagggccattgcggtggcaaaagaaagcggggcggtcatttcctttgatcccaatcttcgtcctccgctgtggaattccctggaggatgccaaagtccaggtcgcttacggactcggacagtgtgatgtgctgaagatctccgataatgaaatccagtggttcacaggagaagaggatttcgatgcgggcattgcgaagctgagaaaagaatatgatatccctttgattctcctttccatgggaagggacggcagcagggcttattataaggatctgaaggtggaggcagccccgttccttcaggaaagcaccattgaaaccacgggggcgggagataccttcggaggaagctgtctgcactacatattaaagtacggacttgatgatctggatgaaagcagactgaaagagatgcttacctttgccaatgcggcagcatccattgtaacgaccagaaagggagcgcttcgcgttatgccggagattgaggaagtggaaagctttatccagtcccgaaactgatactatttaagggaacgcaggtgttcgccgtaccccacaagggggcagcagcacctgcgtacattgtgtacaggtaattcaagttttatgagggagaaaatattatggaagcatacagtgtgttcagagatttagctatcattattgttgcagcaaagatatttgcaattctggcaaggaaatgcaaggctccccaggtagtcggggaaatcgtggcgggcctgatactggggcccagtgtactggggctggtacagcagtccgactttatcctgcagatggcggaaataggcgttattctgctgatgttttccgcaggtctgggaaccaatctgcgtgagctgatgaaaacagggccaattgcgctgctcattgccctttgcggagtgggagtgccgcttgtgggaggcgctcttttatatatgggattttatggtatgatgccatggggatcggaagagttttataaggcggtatttataggagttgttctcacagccacatccgtcagcattacggtggaatccctgaaggaaatgggaaaactgaaggggaaggtgggaaccaccattctcagcgccgcaattattgacgatgttatcggtattatagtgcttacctttgttatcggctttaaaaatccggaatccaatccgggaaccgtaattatggatacggttctctttttcctgtttgccatcggcgttggttttgtctgctacattgcgtttaaatggatggataaaagatatccccatacgaggagaattcctattttgggactggcgctgtgttttgcaatggcctatattgcagagagatattttgggattgcggacattacgggcgcctatgtggcaggcctgatcctgtgttccattcaggattcggattatattgcccggaagatggatattaattcttatatgattttcggccctattttctttgtcagcatcggattaaagacaaatatcggcgaaatgaatatgtctatcctgctctttgccgtatgctttgtactggtagggcttataactaaaattgtgggctgcggcatcatggccaaggtatgccgcttcagcaacgcggattccctgaaaatcggcgtaggcatgatgaccaggggtgaggttgccctgattgtggcgcagaaggggctgaatgtgggattgctgaattccgtatattttacggcagtcattctgctcattgtcttttcttccattcttacccctattattctgaaaattttgtattcgaaggataagatgccgcaggaaccggattcagcgttggcttcttaggaggaaccatgctttttaattcatatatatttttgtttttatttctgcctcttgcgctggcaggctggtacctgctgaaccgcttcaggcagtataagctggcgcagggatatctgatcgggatgtctctgtggttttatgcttattataatgtaagctttctttgggtgattaccggaagttgtctttttaattatggtatcagctttttgctgcatcggaaaaatacgccgcagatgcggaggatatttctggccatagggtgcatagggaacctgggtgcattggggtatttcaagtactgcaatttcttcctggaaaatatcaattctcttttccatgcggattttcagctgaaaaatattctgcttcccctggggatcagcttttttacctttcagcagctgtcctatctcattgacaggtgcaggggggaggcgcctcattatgggctgctggattatctgagctttgttaccttcttcccttccctgatatccgggccgatcgttctccatgcggggacggtttcccagttccgggattcttccctccgcagcttcgatacggaaagcttcgcaaaaggtgtgatgcagttcacgtttggactgggaaaaaaggtgctgcttgcggataccctggcgcttgcggtaaactatggctatgaaaatatagcgtctctggacagtctttcagggattgctgtcgcctgtttttataccctggagctgtattttgacttcagcggttattcggatatggcgattggcatcgggaaaatgttccggattaccataccggaaaacttccgttctccctataaggcggaatcggttaaggatttctggaaaagatggcatatcactctcagcagctttctgcagacctatgtttattttccgttgggaggcagcaggaaaggaaaagcaagaacgatcgtaaatacactgatcactttcctggtcagcggtctgtggcatggagcgaactggacgttcgttttctgggggcttctccatggaatcggcgtggcctttaacagcctggaactggttaaggtgagaaaaaagtggcttgcaagagcttttacctttgcctatatctgcatggcctttgtttttttccgggcggacagcctgggagacggcttccggattatgggcaggatattctccttccaatataacggaagtattacggctctggcagcggcaatggagccggctgagatttatattgtaaccaaggcgctttccatgatagctccggggctggtaagtatggtgcagctggcggtcatgcttgtaattgcggtgatcagcgttgctgtgctggcgcaaaaaactacacagcagcaggtggaaagagaaaaaataacacctgctttcacctttgcggcggcattcctttttgtctggtccgtcctttccctttcaggggtgagtacctttgtttattttaatttctagtgaggataaacggaattgattggatatcctccgaacggcggagaaactatgtatcggaaatttcttaaaaattttgcggcagtgtcggtaatcctgcttattctggcagcagggctggtagtgctgtttgaccccttttttcattatcatgaaccggtggggcctttgaaagcagtactgaccaaaaaagaatatcagagtataggaactatccgtaatttctcctacgacagcctgattatgggttcctccactgcggagaatttcaataacaggtggtttgacgatgcttttggagttactgcggtgaaagcaattaaaagctccggggtgaccgcacagctggattattatatggagcaggcctttgaaagccggaaaataaaaatggttttttacagcctggatttgtttgcgcttggcggggatccggatattgtatttcctgacgagtccatgcccttgtatctgtatgacagaaatccctttaccgatgtcaattatgtgctgaataaggatgttatttttgaagatattccgtacatgctggcggagacgtttctggatgattatgatgagggaacttcctataactgggcccagtacaaaaccttcagcagggaagaggcattgagccattatgaccggccggaggagattgcgcccatgaaggcggaagaagaatataaggaatttgtggacgggaatgtggagcttctggttaagcgggtggagcagcatccggatacgatgttttactttttttatccgccctattccatgctgtggtgggacaatatgtacaggagcggggagctggagcaggttatgtatgcggccgggacttctgcagaaaggctgctgggctatgagaatgtaaggatgtattattttcagaatgacagggatatcattctggatctggatcaatatatggatccggtccatttcacggcggaaatcaaccagtatatggtggaacagatgaaggaagataattaccggcttactgaggaaaattaccgggaagagcttgataaaatgcggaaactggccgaagaaatccgggaaaaggagattaggaagtatttcccataatatttctgtgcataaaaaaccacagacttttccgcttgtctgcagaagagctgtggtttcgttgaaatgacaggacagccgggatgaaaagaacggttatacctttctgaaatcgtcaacaggcataataaagatagttgctccgcccacttccacatttacgggtacgctggaaacagcgttgggatatacattacaattggagggagccggaggggtatacatgatctgctgacgcttgccggaatgctgcttaatgatttcgcataccgcatccactttttcgtcctcgataccaagaagaagtgtggtattgccttttttcagaaagccgcctgttgtggcaagtttggtaacaaaatacttcttttcattcagttcattgataagtaaaggtgcatcttcattatgcacgatggctaagagcattttcataggctactcccttccgccgctttttatgcgacacaagttttctttctattagtataagtattttctcggaaaatagcaatttattttgcagaaatttaacaaaaattgtgcaatttgttaccatttagtgtcctgccgtaccaacagctttgtaatcctgcccggatccactcccctgaactccctgtggggacagcggccctgtaaggttcccgtgcggcgcgcttgtgctcggacaaacacgcagcggtactaaggctgcacaggaggcagcccaaggaccggcgtgtttatacggcccttacaggaatccttacagggccgctgtccccgcagggagttcaggagagcggatccgggcaggattacaaagctgttggtacggcaggacactaaatggtaacaaatcaggttattatactctgtaatgggaaaggaaagacggacgtgaccgataaggaacgctttgattgggccagagataagatagtgggtaccgtacgtgagagacagggtatcggaactctgtcggaaaaaacggtccacgcggttttgaaaaattattatgctccggatgaggatatgcatgagatacccattgaaggaagtgtggcggatatctatacagggacagaaatcgtggaaatacagacacgcagctttgatcggatgagggataagctgagaaaattcctccctttatatccggttacgattatctaccccattccctacgaaaagtggctgatatggattgatgaggaaaccggggaattcagcagccggaggaaatctccggttaagggaaatgcgtatgcagccttcagggagctgtataagataaaaaattttctgttggaggagaaccttcattttaaatttgtttttttgaatatggaggaataccggcttttgaacggatggagcagggataagaaaaaaggatcttcaagatttgacaggattccgctggaaatggtggatgtcatggaaattgactgccccagggattatctccagctggtcccctatgggattccggagccctttacggtaaaggagtttgcgaaggaggttcatatccgggcgaatctcgcccagacagtgctgaacatattgacatatacagaggttgtggagagggtgggcaaaaagggtaatgcctatctgtatcaggtattggaaggagacgaatgagatgaagacacaggaaaacagtaaaacggtaaagctgtatacgggcagctataacgcgccggtactgacaggagacggaagcgcatatcagggaaatggggagggcatatgcctgtggagctttgacgaagaaacgggcggactggaaaagcaggaaagctatggacaggccttaaatgcatcctggcttactttttcaccggacggccgccttctgtatgcggtaaatgagctggatgattatcaggggacacatggaggggcgctgagcgcctataaacttgaggatgacgggagactggctatgataaacatactgcctgtcatgggtgcggcgccctgtcatgtaagctgcgatgagcagcgaaggtttgtctataccgctaattataacggcggcagcctgagctgtttcaggctggcggaagacggaagcctttcagagatgtactggcagctggtccatcagttcggagaaaaagaaaacagggacggaagggacaggctgcgtaatcctgtccgtcaggaaaagccccatgtacacagtgccgccataaagggggacaccctctggattgcggatctggggacggatgaagtttcctgcatggctcccggcaaatgcggaggggagatggaacgtgcggcatctgtttttcttcctgtgggaagcgggcccaggagcattgctttttcgaacgatggaagccatgtctatgtaacctgtgagctgagcaatgaaattgcggttctgcagtgggaaaaggaagagaaaaggatttctgtgcagcagatgatatccagtctgccggagaatgacgggaacggagagaaaacacagagcagcaccgtgggcggaattgttctgtctcctgacggcaggtacctttatgtgggtaatcgcggggatgacagcataggtgtttatcatgtggataaccagggcaatttaagcggggtccagtggatatcttcggatggaaggaatcccaggggatttcagatttcaacttccggccggtggctgctggcggcaaaccaggacagcgataacctggtggtgtttgaacgtgacggagaaacgggaaaattagagaagagatgggtttatgaagccggggcggtggtgtgcctgcagtttctgaagtgatctgaaaatggaaatgtcttccgggaaaatacggaagacattttctatttcaaaggtatggcaataacttaaatcctatccgccacataagcaacagaagtcccgataggaagtttgatttctcctacaagtttattgttttccaatctgcctgttaccttaactttaaccttacccatgggggatttcattttaaacaggaatgtaatcccatcatcggctgcctgccctttttctatatccgcagaatttccggcaagtgataccgttccgtccagtttgtttccgttaactttcaaatcaaactcgattgtattttttcccataggagtatccatagtagaggaccattttccctctatagatgcatcgatggaattggatgagatttcatccggctcatcgttatctgtttgagagaacgtttctgctcctccgccctgaattcggttcatcatcgcgcccatcggattttgtatgctttgagcgccgtctacggtaatgttctgaccagtgatatactctgccatatcagatgctaaaaataataccgctttggccaaatcatccggaaatcctgttcggcccattggcatggcctgttccaagagaccggaaagcatggaaggattgaggctgctgacattttcggtaaagttaagtcctgcattgccggattgttttataaattgctgcatttgctctccattgccggaaaaggccgcgatccgttcttccgtcatggtagctccgggtgttgctgcgttgacagtaattttatatggagcaaattcctgtgccatagtttttgttacataccataccgcctgttttgcagcgccatatgcgatcaagggtcctgtcgggttcaatgcagctgtggacataaagttaatgattcttcctccatgtccttccttaatcatctcttttgccgctgcctgggacatgaagaatgtacctttagcgtcggtatcaaaacatttattccaggtttcttcagtcatggacagtgcatcgcagaatggaaaagaagcggcattatttacaaggatatccagtctcccgtattttttcactgtgaagtcaattgttttataagaatcctcaacagatgatatatctgcctggaagcaggcaacatcaaaacctttgtctttaaattctttttcgactgcctgcagagcttcaagacttctgccggtaaagactactttacagcctgcttctgtaaaccttgtaagaatctgcttacctattccgcggcttcctcctgtaataacagcggtttttccctgcagggataatagtttatccaatgcttttggttgtggtgcatgtaaatcaaacatataaatacctcctggttttgcagtaactgataagcagaacaggcggacgaagaccggtctgcttatcagttacattctattgttattatacttttgttgaatcatccaacatgttgttgtataatttgcattatactatcatgaatttataccatcaaccaacaatttgcttccgttttgttggactatagggagagcatatgaaaaagcagccgcaagtcagggaaagaacccgtgaaaagatgtttgacgcattttttaaggaatataaagaaaacactctcagaggggttactgtgggagctgtttcaagaagagcgaatgtgaaccgaagcactttctatgagtattttaccgatatatatgatctgattgatcaggcggaagactctttgcttacggaaatgctgagtcgaataatgcagctgcagaaagaaggttttaatgaacagcggcagcaactcatggtttatggtgaggaaataataaacgagtacggggaaaggcttgccatactcctggggcatggagataccggattttcccaaaagatgattgctgctatgaaaccggtaacgactgaaatctttcatatagatatcacggatcccaaagctgaattattaatttctttcatactatccggaataaccggctatattacagtctggtataataatggaaaacctgttgcaatccatgatatggtagcagcactgcaatctataatggcgtattctgttagcatcttaaaaaatcaataaatgtttattggaaatgaatataaggatgcaaccggagtatatttttctctgaaaatgcccggaaacaggggctggcctgacggtcgagtccctgtttcccgcgaattcgttgactttaatatgagaaaagggtataagaaaagaaaaagaaaatttatactccgggaggacagacggggaaagagaggaaatctggaaaatggaagagaaggatacatttggtaagttccttagaagaaagagagaggaatgcggcctgacgcagaaggagatggcccggagattatatgtgacggagtctgccgtttcgaaatgggaaagaggaatttcttatcccgacatttcactggtgtctcagatctgcggtgtacttaatatcagtgaacatgagctgattacggcaagtgaggatatggaacagaaaaagctggaaaaacaggcggcatcctatcagaaaatggttcatgtctattccgtaacaatgctggttgtttacggaattgcactgatatcatgttttattaccaatttggctgtggaacgcaggctatcctggttttttattgtactgagcggaatccttacggcatttacgctgttatccctccctttatatttgcaaaagtacagggcggcgattaccttggcaagcttctggatttcattgcttctgcttttatttatctgtgctgtttatacgggcggaggctggttttttgtggccatgtggtcggtgaccctgggtttctccgtagtttttctgccctttatacttcccagcctgccgcttccgggaagtctgtatcagcataaggcgctgctgtgtattgctgctgataccattcttttgtttatcctgctggcatcagccctgcattataccggaaatatgggagcctactttacagtagcctgccccgtggctctggcagggcttttatacgtgtgggtgcttttggcggttatccgttatctgaaaatccacccctacttccggactgccatggtactgggattcagcgggatttatactctttttatcaacagtattctgcatgtgattatagacagagtgcccttccaaatgcagccatgtgatttccggatatggaacggggattatattaatgggaatacaaccatgattctgtttcttatctgtatcctgctggcagctgcctttaccatggggggaattattattactgtaaaaaaacggagtgcggaatcatagagcaagatagaaaagggacagaaatgaaatgagaacggatggaaatgtaattcggaatcagaataaacggcgtataatgattttcagtatttttacccttatttttttaggccttctgggcacggcatatatcaggagcagggaggataacgttctgcttctgcttatgctgacaccggggctgagcgctcttgctgccaggctgatcacaaaggaggggacaaaggatttatttctgcgcccttatttcaggaaaaacgggaagtggtatttggcagcatggattttaacaccgctttttgcttttatgggggcagctatttatttttttatattccgggaagacttccggccgctttcctctctgtgtgccagggaggaagggataaaaactaccgtggattatttccgctatctgggaaccatgcttccgcttgcagttctggtgaaccctttgatgggactggtacagtgtctgggggaagaagcgggctggcgggggtatcttcttcccaaactgctggaatttatgaaaccatggaaagcggttctgcttaccggagtgatttggggactatggcatgcaccggtgatcgcctgtggttttaactacggaaccgctcatccgattgcgggaatttttgctatggtggtgttcagcacggtgctgggatgtatccagggatggctgtttttcaaaaccggatccatatggagctgcgtggtattccatgcggcgcttaatggcatggaccttttctctccctcagctctttttatgggtgcgcaggtaaatccgttcctcggaccggatccgacggggatactgggaggcattatttttgcagggcttgcggcagccgcattttcggatatctgccggaagggctccgaacagattccggcttgataaatgctcagctatacagctgaaggctgtattcttctaatttcctggagatcatcttgaagggatagtacataagggaagcgcagcccaaagataatacaagaactgccgcggtgtataaaaaatcactttgaatataaaacctgtcgcttcggaatacctccagaaacagcccgtggatcagataaatttcaaaggatctggttcccaggaaggaaagaaatttattggaaaaccgtattttcaaggtgagcaggaaaacaaaaatcataaagttaataacagcaattgtctgccatataaagcagatccagttaccaatcatttcctttacaaaaatatgttcattcgttaacaatggctcgatttggtccaatacctggacagattttgggaaaaagtagagaaaggtcccggcagagagcagaaggagccaatagtaccatttccgggtaaatttcataatgggcttttcaaattgtgccatgaggatgcctataaaaaacagactgctggaattaaaccaccactcaccctgaaaccagtaaataccggggccttttgccatacaataggtgggaaacacaatctggaaaatacccaataaaaggaaactgattcctttttttctgataaaacggaaggacagaaaaaatacgaaataaaacagggcaattacaataatataccaggattggggattgatcagctgtatgccgcttaaatattcaagagacagcttcaggccatagcggtctcccgtcagataataaacaaaaagatacagggcattgcagataaaaaagggaacaaatattttaatgtatctgcgcagaaaaaagtgatgaaaatagttcttgttggtaagaacgcttttcatcaggccatatccggaataaaagaaaaatgcagccacacagaggatccccacctccagaaagacccggaaaggaccggggttgtccagatattgggaaaggtggtggtaaacgataaccagtgtgaaaaaaccgcggagcggcagttcaaagttcttggtaaaatgttcctcctggaaatgttccggtccggaggagcttacctgaaaaagcagtataaacaacagaataagtataaaaaaatacatgtaaaactcccttattaaagaatatgctccatacagggttagtattcttcctgttatggaaaaacatgtaatatatcttacactataattcaaaaatgaaaagccttatggaatatacctttaaaaatttcttaatattagtatgaatggaactaaaaaagacaccataaaaaaacgtctatggattttcccatagacgcattttccaatattttctataaatacttcagtgagttattcttcataatcaccccatattacagtatataaatcacaaataatgacggtatcaaccttattgtcatcagatacaatgataccggcatcaaatccttcctgaaattcaaaatctcttgcctgttccgcactgtctattttttcatatttgccatttaccttttgaaacagaagatccgtgtttacatgctgtccgtccaactggaatccatatttttcgtaatcagtactgccgattcctaatccgttcaaaagcttcgttttggaatcgttcgaaaaagagatataggataacaggccgtctgtatatcccagtgtgacaaaaccatagttatacttcttaagcattacttcgtaatcgtaactgctcatgagctcttccactttatcacggctcatgtataattccagtttttctcctgacggaagctttaccccggtcattttatccggtgagtctccggagcatgagcacagaagcattcccaatatcagcataaatacaagtaacaaccctttctttttcataatgccctcctgtatgtattttctttcattatatacattatcggacagcaaaccaagataatttacaatttattttataaaagacaaaccggtttcctaaacttttattaattattgtgctgatgaattgaatggatatacggcctgtgctataatcagcccgtatgcagagaacgtatctttgtaggcgctgtaaaaagaagctgttaaaaataaaagaaagtagagaggtgtcatatgaataggattaaaaaattgcttgctttttgtctttcactcacgatgatctgcggtgcggcactgtctgttaatgctgcgaactcagttggcctggtaaccgtaaggactgatttcagtgaagtttctgttccggcggcagttccggtacttcaatacgccggcagcggtaacagttccattctcaatacggcgcttcctaagggaacggcctacaaggttacctttacctatgggggaaaaggaaattttattgtaaattttattacggatgaacgtaccgagcttctcgtaaacagtattggttcctatgccggcacaacccttttgtcagacggcagtgatgcggtgccgctgggaattttcgatattcgcgccgaaggaaactggacgattacggtatccacagttaccaatctgtctacaaattcagtaacgagtataggggataaagtttcaggggtattcaatctgccgggaacagggacaacagtatccataaacaacaccggaaaaggtaattttattgtgtgggctcattattccgacggaaccagccagcttctcgtcaataatatcggcgcctattccggacaggcagtcttaaataatcctaaaaaaacaaactgctatctggaagtaaaatcagacgggcagtggacggttgatatgggatatggaggtgcgctttctttagtgcccgatattaattaattttaaaaatatgctgttatgagttgatttttacatccgactttgttacactgatacaaaatggtaaagatttcacggtacaggagttatttatggcagagaaaatgatcagaactgcagatttcatgatgcccgcagtcatgtccatgaacttccggtgcttgtagctgtatagtgcagatgcaagtacgcagaggcttgtatctgtgtggtctgaatagattgaattttaccgcatggattccagatttatatttctgataatccatgcggtttttgtctgcggttaattcctgcgggcagcaatgtttcaaattggatattccgttgtctgcggcggggcaattgactctttaaaaaggaattcgaagagcggcaccgtgaatacggttccggtaaagaaaggatttcgggttatgtttaaatccagaggatggaaaaagaaaaaagaatggatttccaggggccctatagtcatgttggggccgctgtcttcttgcgtatgaggacgcggcataaaacagctgtcactaagggtgggggaaccggaatcgaagagaaaaaccccggtttccgtcagaaaacaggaaatcagatatcggaggattgacatggactttatattggaagagtggaaagaggatcatattgccggagttgccaaatatgcaaataatgaaaaaatagcggggaggctgagagattccttcccctatccctatacaaaagaggatgcgcagtggtttgtgggggactgtatggagaaagaaggaaaaacgcagctgtccagagcaattgtagtggatggggaagctgtggggagtattgcggttatgctgaaggatgatgtgtactgcaaatccgcggagcttggctactggcttggggagcccttctggagaaaagggattatgaccagagcggtgcagcagatgtgcgaggaagccttccggcgctataagctggtgaggatttatgcggagcctttttccacgaacctggcttccagaggagttctggaaaaagccggttttcagctggagggaataaaaagaaaaagtatctttaaaaacgggtgcatacaggattcctatttatatgcggttattcatgtatgatggagcagaggaacggataaaggaaaagacagccggagccatatacataaaatatggcccggctgtcttttggcctgcaggtaaaatcaggctgttgatatttcggaacaaaaaacgtaaaagaaggatattatgcggcatttccagcggcggaagcgctgtatataatggaaatccgtccttcaccgtaaggcatggtatattcttttcctacaatgcctttaagctgttttgtgatgtaatcaatcaatacctgattatccagcatagtgcagtcctggagaagcttattatcacggaacatggtaaagccgtctccgccgtttttaatcatataattatgggaggccacggtataggttttggccggatccagaggaatgccgtcaacaagcacatgggatacccggtagtctccgtcaacccggaggaattcaccttcatcattcctgattacggaagaagggatggaaggatctatggaataggtaagcccggatacctggaggaaaccgccgttttcttccgggtaaagagaagcgccaagctccagcgcatccagtatctcctgccctgtggcttccacaacacacatttcatttccgtagggatggacatttatgatatcttcataggtaatatttcctgccttgatatccgcccggatacctccgccattaacaatgccgatatcagcgcccataacggaacggtaggcatctgcacacaggtcgcccagattggtttctccgtttcggatcagacgttcatttccggaaggatcctttgtggtaagtgttacatcggatttcgccactacctggccgagaacgtcagcaaagccatccttcagcgcatggataaaagtatccataaccggatctttatccgtataattttctatcagttcggctgttatagtcccgtttttgggatccagtactattttccccacagcatttaatttggttcctgtctgagcgaggacaacttccttaccgtccttgtttttaacctttttatcgtaggcttcgtgggaatgtccgtcgataaatgcatcgattccgtttgtatttgcaataaccgcttccgactgccactgaggcgtacttccttccatgccaaggtgcccgatggcaatgacataatcggcgcccatggcaatggcggtatccacggaattctgcacgttatcatataaatcctgtccattgttcccctgacagaagccatagatataattcccctcatcatcctggaagtacaaaggggtggatttggtaaagctttccggtgtatcaattcccacataagccacatccacatccccgtaagaaagaattttaaagggaagaaaaacagaggatccggttttcaggtctatgaaattggagcagacataggtgtattcggctctttcttctgccagccggagaaagttgtccataccgtagtcaaactcatggtttccgggcacggcaatatcgtagccggcctgattcatgatatccacaggaaatgcgccgtctgacagtgtgccgatggctccgccctggatggcatctcctgcatccaccagagtaacattttccctgccgtacacctgctccatctgcgccttgcaggagacaaggccggcataaccgatattgtcatcaattccgcagtgaacgtcatttgtatgcagaatgataattttatcggggatatttccttcctgtgccatgacagggatggaaagggtgagggccatgataaaagacagtatcagggccagtggctttttgtgtttcatactcttatcctccttttcttatttattgttatgtgggaatatcaattccccgcacacttttatactatcaaacaaagaaataaaatacaagaattaagaaaatattccttgtttttcactgcgtcactgctatactgaatacataacagcagtactgagtataagaaaaaaggaggggatgccgatggatgagaaaaaggaaatggtgagtcagcagacggaatatgagcgtgacaggagaaaaggcggactgggagactggaaggcgattattattgcattaattgctggaattacggctataatctgtgtcataattttttcgggaaacctaatgaattataagaagaccgccggagccggaggtcttacggcaacgggttcggcaaacctggattttgagtccgatttaattgtatggagaggaaatttttccacctatggggctactcctaaagaggcatatgccgttataaagagagattcggaaattgtaaaggattatctgctggaaaacggggtttctgaagatgagctggtattcagctccgtggatatttcccagcgttatcgtacggaatatgatgagaacgggaattatatcagggattatccggatggatatgatttgtaccagagcctgtccgtaacctcagtggatattgacaaggtggagaatatttcccgggatataaccaaactgattgaatccggggtggaatttgtatccaattcacctgaatattactgtaccaaactggatgaggtaaagctggagctcattgaaaaggcaacggataacgccaagcagagaattgatattatggcggctggtaccggaagccggacaggagagcttctcagtgcgaaccttggggttttccagattaccgccaagaattccggatccggagagtacagctacgacggcgcctttgacaccagttcccgatataaaacggcaatgattacggtgaagctgaactatgcggtggaataggggatgagaatccggtgattcttttcaaaaggaaaaaagaatatacatacccggaatttgacagggaaaaccagattccggttttaaaatgcagtatttgtacgggtgagaaggtggcgtgcttcagggataaaagaacggggcacacggaagaaatcatgtatatccgaagccagggtgatatgcaggattttctcagccggtacgggctgtcggaacaggaaataaaaaaagagtggtagagagcatcaggaaagcagcgcggcagattggggccgggctgcttttaccatgggaagaatcccgctgcttctggcgcactcacttttttatctgtacttcgatctgtatttcattgaaaagtaagggctcccgaaagagagttaggtgtgataaaatggaattgatttttggaacagggaatcatgggaaatttatgatgatgaaggatttcctggaagaactgaatgtggatctgataggtctggatgatttgccgggagtggaggaaagtccggaagagtcaggaagtacccctttggaaaatgccagaatgaaggcggaatattattaccgcatttttcagaagccggttttttcctgtgacagcggattttatatccatggtcttccggaggaagaacagcccggagtccatgtgcgcaatgtgggagggcggcggctgtccgatgaggagatgacggcttattattcgggtatcgcccacaggctgggaggaaaatgcctggcagaatacaggaatgccatctgcctgatcatgaacagcagggaacggtacgaatatgagggagcagatatcggcggaggaagcttctatctggttgacagggcaaaagaacagaaggaggaaggttttcctctggattgtatatccgttgatattgtcacaggcaattatttcgtggagggcggacagctgcagtgctttgattcacagaaagagggattgctccgttttttccgggaagccatgcagaagacggaagagagtttacagagcggaaggccggagaaatgagccggaagaggaagcaaaggagagagaaggatgtttacaaagagactttattttgaaaatgcctatataaaagagtttgatgccagggtattgagctgcgaggaaggaaagaacggatacgaaatcgttctggatgaaaccgctttttttccggaaggcggaggacagcccgcagatcaggggtatctggaggatggggaagtgacggatgtgagggataaaaaagattatgtcctgcatatctgcactaaatacctggagccgggaactatggtgcacggaaagctcgattggaaccggcggttccttcatatgcagcagcattccggggaacatattctttcagggattattcacaggactcacggatacgataatattggctttcatatgggtaaagattttgtgactgtggatttcagcggtcttctgactgaggatgagatagcggaagcggaaaaaatggctaatacagtggtatttgcagatgaacgcatacttgcggaatatcccggaaaggaagaactggagaaactggaataccgcagcaaaaaggagcttgacggggatatccgcatcgtcacagtacccggagcggatgtatgcgcctgctgcggaacacatgtgaagcgcaccggtgaaatagggccgattaaggtaacctcctcggaacactataaatcaggaatccgtcttacccttcagatcgggtggatggccctcggtgattacgacaggaagcagaggaatgtgaaggccgtatccaatctgttatccgcgaagccggaagaaatcggggaagcggtgcagaaacagctggaacagatgcaggaactcaaacaggaaaatataacgctgaaacagcgtatttttgatatgctcctgaaggaaacgccggaggggcaggagaaggcggttctttttgaaaaaggactgaattcggtagaagtgcgcaggcttgcggacatgctgtcgtcccgggccggactggccgcggtattttcaggcagtgacagtgagggttataaatatgtggtatgcagcgtggataaggatgtggccgctttgggaaaactcatgaatcaggagctgaatggcaggggcggcggtaaaaatcccatgatacagggatctgtccaggcagaggaacgaatgatccgcaaattttttgaagaacattattgacatgtttttatcaaaatgatatgatgaatttcacgataagggagtagttagcacttgacggtgtagtgaagtcaacatactgataacacggttatctggctttgctttaaatgatgagacttatctgcccaaagagcagataggtctttttttattcttaagaaaaaagacgttcctggccggaggggtaaaaacaggtatcggagaacgccggaaaaagaacggctgtattttggccatataaaagggtcaaacgaggaggaaaaggaatatgagtctttgggagcttttgataattgcggtgggtttgtccatggatgcttttgcggtatctatctgcaagggtctttccatgaaaaaaatgagttggaaaaatgcgctgatcgcgggtttgtatttcggcggtttccaggcgggaatgccgttaatcggttatctgctgggcacccagttcaaggatctgattactagtattgatcactggattgcgtttgtcctccttggccttataggattgaatatgataaaggaatccagggaaaaagcggaagagggagaatgccagaatgattccttcggtataaagaccatggttcctctggcggttgccaccagtattgatgcacttgcggtgggagtcacctttgcttttctcaatgtggacattgtaccggccgtatcctttattggtacgattaccttcttcttaagcgttctcggaattaagatcggaaatgtattcggcacaaaattcaaagcaaaggcagaattggcgggcggtattattctgatcctgatgggaaccaaaatacttctggagcatctgggatttttaagcttttgataagagagggggaagaaggatgaaaacaagaaaagaaatgatagccttttgcctcacattcaagggcgtctacgaagactatccctttcatgatgacaactggacggtaatgcggtgtaaaggcaataaaaaaacctttgcttatatatatgaaagaaacggccttgtccaggtaaatgtgaaatgcgatcccgaatggatccaattctggagggacgcttatcccggtgtactgccgggatatcatatgaataaacggtactggaatacggtgatccttgacggctctgtgccggacagggatgtccggcgcatgataaaagaaagctatgagcttgtcaggccggcagaaaattcatgacgatcattaccagacccaggagggtaagcacacctcccgtagcccggttcagagttttggcagatgccttattggcaaaccgggcggccagccttgcccctataagcgtgaaaaggatacagagcagcagggcaggaatatcaggaatccctccgatggtaaagtgggaaaccgcgccggtaaatgccgtgaaggccatgataaagacgctggttcctactgccgttttcagttcatagcccagaacactggtgaggataagaagcatcatcattccgccgccggctccgataaagccgcagataaatccgatcagggctccgcagagaagtgactggatgattttggtgcgcgtatccttatcggcctgtgtctctttggtagtcatgacgggctttaccaggaatttgatacccagcagaaatgtcatgaccacggaaaagcttcccatggaccggttggggactttggaggcgatgaagcttccgacgagagtaaaaacaaggacggaaatgagcatgataattccatttttcacatccaggtttttgtgcttcccataggtataggcggaaattgcggaggccagaacatcggaagcaagggcgatgcctacggcttcataagcgggaaaacccagaaaggttatgagcatgggtgaaataacggcagcagcggacattcccgcaaaccctgtgccgataccggctcccaggccggcaacaatacatacgattaatttttccaacatcttttaattctccttcaggttttgggatataacggatataacgtgatccactaccttcatttcttcttttgtaacccctctgcaaatatattgaagaaaatcctcctgacatttcctggccgccctgacggcgtcaagagcaggagggcatatccgcagatgtatgatccggcggtcttccttatctgtaattccttccaggtaattacgccctgtcagaacatcaacagctttggaaacattggatttgggaaaggaacgcagttccacaatatccgaagccgtatcgtagccgggattattatacagaaataaaaggacgttgatttccatccggttcaggccgtaaatctcactgacctcacccaggtatctgttgtacgttttattcagctttctccctataatcagatattcaatgatacgattcatatacaccacctcgcatagttctttttagaactaactggattcataataccatgtactccgtaaaagtcaagctttgtgtaaagggtgcagataaaaaatatcggctctgcctctgccctgccttccgcctgtcggcctcccccggcccgtattcggtgatgccccgccgtctctgctgtcctccctgtgcgatcgccgccctgcaaggttcctgtgcaggcacgctctcgctcggataaatacgcagcggtactaaggctgcaaaggacgcagcctaagaaccggcgtatttatacggcctttacaggaatccttgcagggcggcgatcgcacagggaggacagcagagacggcggggcatcaccgaatacgggccgggggagacacgcaggcggaaggcagggcagaggcagagccgatattttttatctgcaccctttacacaaagcttacaaactcataaccatatcctgcttttttcttttggggaaaacaggtatcattgcaattgcaaacgagataaaaacagttgtaaaggagaaaattattatgaaaaagaaatttgtagcaattgcggcagcagccactcttgtgatggcggtactcgcaggctgcggttccacagacacttcaaacgttaatgcagcgactgccgcatcagaagctcctggcagtgaggcagctccggaagcggcatcctcggaagcagtaagcagcgaagcgccctcttctgaggcggcagcagatttgagcggaagtatttccatggctggttccacttctatggaaaagttcgcgaatgctttggctgaaagctttatggctaaatatcccggcgtaaccgtaactgctgaatttaccggttcgggagcaggtgttgaagcggttgccgcgggcagcgttgatataggaaattcttccagaaatctgaccgatgatgaaaaggcggcaggcgtggcagaaaatattgtagccatcgatggtattgcagttgttacggatccggctaataccgcagcaggtctgacaaaggaacagctttcagggatctataccggagaaatcaagaactggaaggatgcaggcggtgaggatcaggctatcgtagtagtcggcagagaagctggttccggcaccagaggggcatttgaagagctgcttgatatcgaagataaatgtgcatatgccaatgaactggacagcacaggcgcagttatggcaaaggttgcagcaactcccggagcaatcggctatgtatcactggatgttattgatgatacggtaaaaacccttgcagtggacgatgttgagcctactgttgaaaatatcaaaggcggcagctatctgttaagcagacctttcgtaatggctaccaaaggagaaatctccgaacagacggaagccgtacaggaaatgttctcttatctggcatcagatgaaggaaaagccctggtggaaagcgtcggactgattaccgtagactaatcccataagaacaaaataccagcaatattcaaaccctgcgaaagcagggtttaccttgcgaaagcagggtttaccttgcgaaagcaggtccctataaggataaggaaaatcatatgaaacaatctttttcaatcataggaagcagacaatcaaaaacggcagtggaaaaaactgctcagctaatttttatcgtttgtgctttttttgccgtacttgcagttttctccattaccatatatatgttgataaacggtacccccgcgctgtttaaggtagggttaaaggatattctgttcggaaccgtgtggaaaccgacagctaaggatcccagcttcggtattctgtatattattctcacttccatagtaggcaccactttggctattctgatcggagtgccgataggtgttcttacagccatttttcttgccgaggtggctcctaaaaagctggcggcggtggtgaagcctgcggtagagctgcttgccggtattccgtccgttatttacggtcttttagggattatgatattgaatcccttgatgtataaggtggaaacggcgctttttaaaggttcggaaacccatcagtttaccggcggcgccaatctgatttccgcagttatcgtattggctattatgattctgcctacggtcattaatatcagcgagtcggctctgagggcagttcctgcccagtataaggccgcttccctggcattgggcggttcccatatacagaccatattcaaggtgatccttccggcggcaaaatccggcattgccacagcgattgtattgggcgtggggcgtgccatcggtgaggctatggccattaccctggtatccggaagttcggtaaatattccgcttccctttaattccgtgcgttttcttacaaccgcaattgtaagcgagatgggttatgcatccggccttcacagagaagttctgtttacaatcggactggtattgttcgccttcatcatgattatcaatacctgcctcacaaagattctcaagcctaaaaatgtggaagagaaagaaaaaagggtgaaaagtagaaaaagccaggtggtaaaggcagagattcctgacagcagcgtgggagtagcggctcagagcaaagcctgaaataaccggttatccggaacatgccgcctgcggcacggaggaataggaatggatcaaagtatattgataaaaagggtcaggatatctgactatattataacagcactgatttatgcggcggcatctctgtccatattattgctggctggaattgtgtgctatacctttgtaaaaggggtatccagcatcagctggcagtttctgacaacggtgcccagcacgattaaagaaaccttcggtattgcgggaaatctgctgaataccttatatattgttattattaccctgctgatcgccacgcctgttggcgtaggatccgcgatctatctgaatgaatatgccaaacccggaaaaatagtgagtacgattgaatttaccacagaaatcctttccggaatcccctctatcattttcggccttttcggtatggtatttttcggaacgaccctgggttttggatactctattttgaccggtgcacttacactcacactgatggtgctgcccctgatcacccggaatacccaggaggcattgaaaaccgtgcctgaaagctaccgcagcggtgcgttgggaatgggcgctaccaaatggtatatgatacgtaccattcttctgccttccgccatgcccggtattattacaggtatcattctggctgtgggaaggatagtgggagagtctgccgcccttctgtttactgccggaagcggctatctgcttcctaagagcggcatgggattcctgcataaaatcctggaatccggcgggactctgacgatacagctgtatctgtgtatgtccaaagcgcagtacggagaggccttcggcattgccgtggtactccttgttcttgtgcttggcatcaatatgctgaccaagtatttgtccggaaagtttaatgtggagacgagagaatagtaagggtggaattccctgatggatacacacgtaactcatatgcccggcaaagcgggcagacaggagcaatgatggaaaacgcaaaaatcagtacaagaaaattgaatttatattatggtacgaaccatgcgctgaaggatgtggatatggatatcagcccgaatgccattaccgcttttatcggtccctccggctgcgggaaatccacttttctgaagaccctgaaccgcatgaacgatctggtggacggagtgaaaataaacggggaagtcacgctggacggtgaaaatatatatgatgaaaaggtggataccacactgcttcgtaaaaaggtgggtatggtattccagcagccgaatccgtttcccatgagtatttatgataatattgcctatggccccaggatccatggaataaaaaataaatcacagttggatgaaattgtggaggaaagcctgaagggcgcggctatttttgatgaggtgaaggatcggctgaagaaatccgcgctgggactttccggcggtcagcagcagagactgtgtatcgcaagagctcttgccgtacagccggaggtgcttttaatggatgaaccgacgtcggcgttggatccgatctccacattaaagatagaggatctgatggaagaccttaagaaaaaatatacggttgtggtagtaacccataacatgcagcaggcggccagggtttccgatgaaactgcatttttcctggtgggtgaggttgtggaaaaggatttgaccggaaatattttttcaaggccaaaggacaagaggacagaggattatattacaggccgtttcggatgattgcaggtgaaacgatatatataattggctaataaggaaatgcgaggagcaggattatgacagtgcgaacgatttatctggaggagttgaacagcctgcgcaaaagcgtggctgaaatgggagaagccgttgaggcttcttttgatatgctgctgacggctgtggacagtaaggatgaggagctggagatgcagattatccggggggatcgggtgatcaatgacatggaaagaagcattgaatcaaaatgcctttccctgataacccggcagcagcctattgcaggggatctgcgtatgatatcggctgccctgaaggtggtaacggatattgagcgtatcggagatcagactgcggatattgccgaacttcttctgcggctgaagggatgtgatctggatgcttattccaggcatataaccggtatgcttcaggtgtcgaaagaaatcgtccatgatgcggtccatgcttttgtaacccgaagcagtgatgcggcaaacgaggtaatacgccatgatgacgtagtggattccctttttgccaaggttaaggacgatctggtttacatgcttcaggaaggcgtagacaatatcgacgcctgtgtggatgtgctgatgatagccaaatatctcgaacgaatcggggatcatgcggttaatattgcggaatgggaaattttccaggaaagcggatccatcaaggacatccgcctcatgtaaaacaagaagagaacaaagctgagggcagtacagactgccctgccggaaagctgcccattaacgccgcagctcctgttctcttttttgtacgataaatttgacatataaaatcagggcgatcagaaagacgacacccaggctgtttgtaacctgctgggcatacagggtctttcctccgatactccagcctgcctgctgaagaaaagaaagaaatctgccggccacaaaagacaccagaaacccataaacgcctccaatggaggagaggatggaaagctgcagagtccttttttcttcattcagaagctccagctggatgccgaacagtccgataccggcaaagctccagcccaccgccgaaaaaatggtggcggcaatggtcatgggataggcgttggagggaacggaaacagccataaaggcaaaattcagcaggatgccgatcagggaatatttatacatataagccataccaaaacgatcccccatccgccccacaacaggagtgatgacgatccggaccaaatttccgaaaaaaccaaccagcatgataaatgtgaagggaaggttcagttctttaatctggtagctggtattaaagggagaggatgtataaaaagcggtgagccataacaggttggtaaaaaaagctttgcggaaatcagaactccggaaggcttcttttatttctgccttcagtacgcccttttgttttttagcctggttttccatatatttttttgccaggttgccgtgaagctcctgtccggcggcattcagtatggcgtaacggggctctttcatacggctgaaggcgcagaaattaatgaggacaaggatgaaaatcagcatcccgttcaggagaaagcctatatgctggcgttctccggcagtactgtccataatcacgccggcgcccagcataacagttactgtgacaaatacggccacagcgtcttttttggagaaatagcttcccctcagttccatggggacaaggctcgctatccagtcctgtgtggcgggagtcccgatttgagaccaggcctgggcaagaaaataccctgcaacgataaggaactgctgaatatgaaacggcagcggaagcagggggacaaaaaagatcaaagaaaagaacagcttctgcagtacggtgatacagacaaaaagctttctttttttcagtttattaatcggctgcatggtaaagagctgaaacagggcagccaggcttcccatggatgtgataacaccgatggacgcatcaggaatatgtacggacagcattaaggaaaccagaaaggttccgcctgccagctgggcaatcgtctggttggcggaatcacccgcaatgaagtttttccggcttttttcatagtccccttcattttcgggaagggccataaaataaatcctgcgcagccgccccagcagccaggtgaaatcaagcataattttgctcataaaataccccatttccgcgtcctgcgcggccttcccaagtactaccctcagcctgatattacaataaggaaggccggaaaaaaatgtattatcttagtcaaattgatgtattttattgctgtgcggaagaaaaaaccagaggctgatttcggaaattgacagggaaccggatacgaattaaactgataggaaaaggaagagaagttttaagttcttcaggaggaagggtatatgagaaaaatgaattcggcggcgttaatcgggcttggcgctatgggagcttattttgcgccccggctttatgaggaatacggcgaaaatttcagggttattgccgggggtgagcggaagaagaggcttatggaacagggggtgtccattaacggcgtaaattatcattttcctgttgccgatccggaacaggccggagagcccgccgatctggtgattatcgcggtaaagggctatggcctggatcaggcggtaaaggatatcagaggctttgttggtgaaaagacggttattctttcggtgctaaacggggttgacagtgagcagaaggtgattgatgcatatggtgaagctcatgtgctttattcctatatgagggtttccatagtgatgaaggatggctgcacaaattatgatcctgcgctgggaagcattcatttcggagaaaaagagaaccgggaaggccattattcggaacgtgttatggccgtaaaggaggtttttgacagatgcgggattaccggaattatcgatccggatatgataaagggcatctggtttaagttcatgtgcaatgtgggagaaaatctgacctgcgcccttctgggaattccgttcggagcctttcagagaagcagccacgccaatgccatacgaaagcaggctatgcgggaagtgatgcagattgccgtaaaacagggtattgatttgagtgaagaggatatggaaaagcaggaggaaaccctgcgcgggctccctttcctgaataagccgtccacactgcaggatctggaagcggggaagaagacggagattgccatgtttgcgggaacggtaatggagtacggaaacagactgggagttgccacgccggtgaatgaactgctttaccatggtatctgcgtgctggaggagaaaaacgaaggtttgttttaaggcagggatgggggaacatccggtaaatactaaaagagtatgtttgaggcaggacgggaaaaatttcgtgacaggaagaagtcacgttatttttccgtcctgcctttttagtgcttttacatatatgaaccggagaacaggattgtatgctgctgtccgcctttaaaatcccgctctcgggctgctatttacctttaaaatcccgctcaccccctctcactattgtaacctgaattgtaattcaagattccatacccaggatcttgaatgggacttatagttatattacatggggaaaagagaagggtatggattctcttttgcaaagattgagactgactggaaagatgatctccttttctgctatactttgatctctggcagctggaaaggagtcgccatgtcaaagtttttatcatacgaagatcgtctgatcatatctcagcgtattcaggaaaacgcctcttttggggctattgcaaaggaactgggaaaagaccgcacaacgattgccaaggagatccggaaatattcctatgacaagaagagcggacgtccaggatacccctataatccatgtaagtaccgcaattcatgtaaagctaaaaaaatctgcggtgcgaatggatgcacgcatcagtcagcctataaatgcagcctgtgttcggaatgtacctttcattgccctgattttgaagaggacatctgttctgttaagaggaaaccaccttacgtttgcaacggctgccgtgctctcccccgatgcacccttttaaagaggatttatgatcctgcggacgcacacgaaatggcgcacaagactatttctgaatcaaggacagggattctgtcaaatgaatccgatatagccaggatcaataagatcattactccgctcgttaaaaacgggcagtccctccatcaaatctatacggagcatgtcgatgagctgatgtgcagtgaaaagacgctatataattatgtggacgctcagctttttgagatcaggaatatcgatctgccacgcaaggtaaagtatcgtccccgatacaaacagccggaatttaaagtagacagggggtgccgtctgggacgcagttattcggatttccaaaaatttcttgaaaaataaccggagacaaccattgtgcaaatggatagcgtaatcggacggcccggaggaaaatgcctgctgacggttcattttgttgagaccagtttcatgctcgcttttctgagggattccaatacggctggttctgtcaaccgtatctttcaaacacttgaccgtattcttggagctaaggaatttaatcgtctgtttccggtgattctcacggataacggaagtgagttttccaatccaaaggagattgagtaccgggatacagtaccaatgcgtcgtacaaacgtcttttactgtgatccgagttgtccttatcaaaaaggcgcctgcgaagtcaatcatgaactaattcgccgtatcctgccgaaaggagaaagctttgatgatctgacccaggctgatatatccctgatgatgaaccacatcaactcttataaaagaaaaaagctgaacaaccgtagcccatacgatgcgttcagcttttactacggagaagatctgcttaagaaactagggtgttcgccggttgctgccgagaacgtcatcttaaagccgaaacttctcaaaaagtaacaaaaatcttgtgtgagctgccagaacaaaccagatcaaaaaaaggtaaaacgggatggattctccgaatacaaaaatttcgaacgggaattgattcttgattgtcatacacaagatcctgctgtacgcattataacatatcaaggtacaaatgaaaatacgggaaactcgcttgcaaaaggagaatttcgtttacaaagggggaaactcacttacaaaacaggattttcatttacaaaacgggaatcctggattgcaaacgggactctcgggctgctatttacctctcactattgtaaaataataaatatttattgtaaatcaataaaaatatattgactttcaatgagaatgatgctattttatggaaaagaggcattaaagttttgcaggctcactttcatggcacagtgctgctggggcacatacgaaaggcttcgggagaaataaaaaaatgaagacaaaaggcaaagtggtttttcttcttggtatgctggctttaaccgcagggctgctgctggcgtaccggattagtgaaagaaactcctatctcaggataatacgggccaactggcagacagacctgccttatggctgcaggcagctgtacgagattgacagcggaaaaagctttcatggagacggggaacgttatcatgtgttcctgtatgatgaaagaaaggaacagcctgttctggaggacgggagtcttttgtccggggcttcaaaggagcgggtgattgaaatactggacagtctgggagccgataaagactggtacccgtattttgaaaaagtgacagggaaaaaaatttacaggaagcaggacggttctgtcatgtaccttctctatgaaggcggggaaagaaagctgtatgtggttgaatattttttatgagcaggaggaaagaagaaattatgggaaataagctcacacgctttaccaaattaatgctggatgtcatgttttacgcgggaatagtggtgacattgacgcttccggtttccgttaaaatttatgggcagatcaattcctattttgcccagtattatgtccatatgattattatgtttgggatttccgggatattggccgaattgatcctgtatgagctgcgccggattttccgtaccgttctggaaaatgactgttttgtccgggccaatgtgaagagcctgaaccggatggggacctacagctttctgattgccctcgttacggccggcaggctgttcctttatttgacacccgcggtgatgatcatcatcctggtttttgtaattgcgggcctgttcagcaaggtactgagtcaggtattcgatcgggctgtggcttataagattgaaaatgacctgacaatataggaggtggaaaatgtccataattattaatttggatgtaatgatggccaaaaggaaaaagggactgacggagctggccggagaggtggatattacactggccaatctgtctattctgaaaaataacaaggcaaaagcggtccggctttccaccttaaatgcaatttgcaaagccctggaatgtcagcccggagatatccttcagtatgtggaggatgaggaagaagacaatgggagcaacagcctgtaggaggtatatatcatggattatggcagaatggattcggtaaacgggaattatacggcggagaacagtcatatggcggagaataatccggcgtgggcggagcaggaaagaagaagggcggaggaaagaaaaaaggaggaggaaagaaggctggaggcggaccggaaagcggcggttatgcggggcgcctttccatttttcggatgggccagcgcggtttatgcccttttttatacgttctgtctgtacaaaaatgcttcagggattacctacccttttttcgtcgcaggaacccttgcttattttggcttatgtaccagaaagtcaggggttccattaaaaaaagacagtatctttaccgttgtgagcatgatactgctgggtatatccgtgtttctcacagacaatgtaagtatacagcttataacaaaaacaggaatttttctccttaccctgagcctgatgcttcaccagtatataaatgacagtcagtggaatttttccaaatacctgctttccatctgtcagtgtctgctggaaacgatcgcctgtgtgggacgccctttcagtgacggcgctgtctggaggcagaaaaggattcaggagggaaaaaaggatggcaagggacgttatgtcgcattgggacttcttgtggcagtccccctcgggctttttattctcgcccttctggtgagcgcggacgcggtattccgggatctgttcgtacgccttttccgtcatatcaatatagggaacattcttctggttctttgtatgcttgtactgggcttctttgcttcctacggcttcatggctatgctcaacagccgggttattaaggaagaatgcagggaaaacaggaatcaggagccggtgctggctattacctttacctctgtactcgccgttatgtatctggttttctgtagcatccaggtggtttacttatttatgggacagatgagactgccggagggctatacctattcctcttatgccagacagggctttttccagctcctcgcggtatgtatcataaacctgatcatagtgcttgtatgcctgggatttttcagggaaagcagggtgctgaaagggatactcactgttatttccctttgtacctatattatggtggcatccagcgcataccggatgattttatatattcagatctgtcagcttacttttcttcgtattattgtattatgggccttagcggttacggctctggtattgggcggcattattgtcacaattttcaggccgggtttccgccttttccgatactgtgtcactatagtcacggtgttttacatcctcctggcatttgcgaagccggattactggatcgcaaggtataatatgcagattgtggattttaccgccgtcagtgaagagccggcggaggacagctacagggacttctattacctgagccatctgtcagcggatgcggcgcccatactggcagccccggaaaattatgaattcctgaaaaataagtcctattccatggaggaatatttttcccgtatggaaagaaaatcagagggaatgggaatccgcggttttaatgtttcccgttaccttgccgggaaagcaatcgataatacaaagaaataattatttaaatttttcttaaatagtatatactccattgacacctgaccgtttagagcgtaatataattaggacacagaattttcacatttgggaggaaataaagatattatgcgtatgaaaagaatggcagcagcagttgtggcaatggttaccgcactggcacttacagcatgtgcaggtggatttgatgccagcaagtacgtgaacggcgtactgaacaatatttatctgggagattccacgggatatatggaattggtagacataacggcagatgaggctaaggaagaatacgagcagggaattggcgtcgaagcagactttttcctgcagtattacggcctcgacagtgtatctgatgatgtatatcagcagatcgtagacatgtataagcagatttacagcaagtccaagtttgaagtaaaggatgctgtaaagaacggtgatgatttcaacgttgaggttgttgtcagccctatcgatgttattgtgaacagcgaagatgctatcagcacagcagtggatgattttgtagccaatgccaatccggatgattataccgatgatcaggtgctgaacgatgaccttgctaagctggttataaaggttatcaacgataacatgtctaacctgggatatcaggcagagaagtccatcattgttaaggtggaaaaagatgcacagggctattacggactcagtgatgatgccatcagccttctggatcaggatatgatcgcctactaagaagaattattaattacataaagaaagctaacgtaaccgtactctttttttaagggcacggttacttttctatagagaaaacagagcgccgggcggcgcagagaaggagcggatatggagaaattcagcgcggaacagttcattaattttttaggaaagatagaaaaactgaaatcagtacccaggcattgtgtgacggcggacggtgttgtggaaaatgtggcggcccacagctggcgcacggccgtaatggcttatctgatgaaggatgagctggaggatattgatacggataaggtcatccgcatgtgcctgctgcatgatattggtgaagcggtgacgggtgatattcctacgtttgaaaaaacagaggaacatgaagaggtggaaaaacaagctgtggacgagcttttgaaaagcctgcccgggcctctgtatcaggaaatcacagccttgtttggggaaatggatgcgcaggaaacaaaggaagccagagtctataaggcactggacaagctggaagctgtcattcagcataatcagagcgatatccgtacctggctgcctctggaatacgatttgcagaaaacctatgcggccgaggctgtgaaaggttttccttttctggaacagctccaggaggaatccgtaaaagagactgaaagaaaaatagaagaatattccacaaaataatgaatcaatatccaaacttttttcaaacactgtccatctatagtatgaaaggaaacgttgtacaacggtccaatcgtaaaagccgccgttcatccgggctttgacgataatcataagggtaatccaatcaggatatatgcccgcatacaggaggatataacaatgaagcaggatatttatgacctgacagtggcctatatcctggaaaaccaggaaaaatgttatcggctggcctacagttatgtacaggacagggacagtgctttggatgtggtgcagaattccatatgccaggcattggaaaagtgctggggactcaggaacccggcggcaatgaaaacatggttttatcggattgtggtgaatgaggcgctgcagtaccttcgcaaaaataaaaaggaaatcagcaccgaaccgtcggaaataagagaagagccctatcaggaatatggctttgaaaaagcagatatggactcaaatgaggtctatgaagaaatacagaagcttccggagggtatgaagacagtgatcatccttcgtttctatgaggagctgagccttcaggaaatttccgaagtgacgaaaaccaatttaagtacggtaaagtcacggttgtatgccgctcttaaaaaactgcagaaaggtttggaggagatcaattatgagaaagcctgaagatggaaaaaaagtatatgataatatagaaataccggaagaattaaataatgtagtaaaggatgccatccattccatggacaagggaaaatccataaaaaagcatcgtacgcacaatgccgtaaggatcttcaggtattgtggcacagccgcggccgcgctgctcgtatgcatgacaataggcctgaacacaaatgaggttttcgcaagggaaatgggcgaacttcccattatcggttccctcgcaaaagtgctgaccatacgttcctatcacgaaaaagatgaaggccatgatattaccgtaaacgtaccggaaatacagctggacgaaacacagaccggtgatgcggatgcggggaaggaaacctttgtaggagatatcaatcaggaaatacagacaatcgtggacgattatgtggccgacgcaaagcagaaatttgcagaatacaaagaagccttctttgccacgggcggaaccgaagaagaatggggaaacagggacattgcggttaatgtggattatgaagttaaatatcagcagggcaacatcctgtccatggtattgatcacagatgaagcctgggtatccgcatacggagtccgttattactacaatctggatctgtcccggaacagacagcttacccttcaggatctcctgggtgataactatgtggaaattgccaacgaaagcatcatccgtcagatgaaggaaagagatgcggcagacgagaatgcggtttactggggaatcggaaaagcagcagatgacggtatggtagatggtttccagaccgtagacgaaaataccagcttctatatcaatgcagacggcaaccccgtagtgtgctttgaaaaatacgaagtagcgcccggatacatgggatttcaggaatttgaaatacagaagcctgtccaataacaggcctgcttaataaacaagccggatgctgcgtccggcgtcctccgatggaaaggacgccggcccataacatccggctttttatttctgcccgtaatcccacgctttctcgttcttttttgccttcttctgctctttttttatagtatccagaacagaatagagaagatgccttacaacagaagccagcggccatatcagccagctggtggaccaggaatggaacagaaagctccatataaaatatatacaggtaatgagcggccagtaaacggaaagaatcagggaaatcgtctgaccggcctggctggaagaaacagaagatttctttttcttttttccctcttttttcttttcctgcagaagtattttgtaaatatcctcttccgatcctgcggtgacaaagagataaacggcgatggaaataaataaaaacaggaagaaaacacctatggtaccgccgtattcctctccgagggaagtgctttccccaagctgtgacagggctatgagagtaaagggagctaatacacacagcacaatgcccactgtggttattactgcgcactggggctggaaatttgcctgcatatcggctacagaggcctgaagagagggacttaaaatcaggttggagtgtttcaggaacttatactgttcaagccggctgcttccataaatgagcatgccaagacccgctgccagacagagaaaaagaggaaagagagtaaaaacagcctccagtctggataagcgggcaagctccggtctgacggaagaaaacaggccgtttattaaaatcattaatgccggccccatgatacataaagaggttcctgcccctgtcagacggctatatcttcgggtatccgaaataacctgttccacctgttctccggataaaaaaacggctccggtatcataatcttccttttcatgagtataagaggaagcctcagactgctgccagcccccgccggtattggctccggcttccctttctgtattttgggccgtcttcagtcccagctcttctatcagttcatctatattgccgaattcggaaatgacgattccgatggcttcattttctgattttccctcgcttttcagctcttcgtatttatcctccatggtgtggagcatatcattctgcagcttcatgatctcaggggtcccgggaagccgggcgaacatattttcaagataaattcgtatggtatccataaatcgtcctttcttacagtcttatgaactgttctactacttccttggtcactttccactcttcacatttttcacggtaataattccggccgttctccgttatctggtagtaggtacgccgcttcccgttggtttcatctccgtaaaaggattcgatatagccgtttctttccagccgggtaaaggcggaatacagggtcgtttctttaatgatgtacttgtctcccgagcgctctcttatgtgtttggatatttcatatccataggaaggaccgtccagaagatgaaaaagaatgaaggtatcattgtagccgcggatgatatcactgcttatcaattcatcagctcctttttattccgacggataaggaaagactactccgtctgacgtactatgtctgtcgtagtaattacagtatagcagattatcatacgatgtcaatcatttacaagccttttacaaaattttgaatttggtgtgatagttgccggggaagggggttgttataatttgagtgcttaagaaaagacagcagaagaaaggaagggcggcatgctcagtttacagcatattaaaaaatcttatgatggtgttcctgtactgcaggatattacgttggatattaaggatggggaaatcgtatccatattggggcccagcggatgtggaaaaactacgctgctcaatgtgatcctggggataactgacgcggatgaggggaaaattcttttccatgaggaggatatcacccatgaacccatggaaaagcggggttttaatattgttttccaggattatgccctgtttcccaatctgaatgtatatcagaatattacatacggcctgcgcaacaagccgggcatctcctctgaagaagaggtgaaggagctgatccgccttctgggactggaagaacacctggataagaaaatcgatcagctttccggcgggcagaagcagagagcggcgttggcgaggacgatggtgatgaagccccgtattctgctgcttgatgaaccgttaagtgcgctggatggtgtgataaaggagtccatcaaggatcggataaagacgatagccagggaataccatctgacaacaatcatcgtaacccatgatccggaggaagcgctcacgctttctgatcgtgtgcttattattaatgagggcggtatttcccagtatgatgagcctgcggaaatcatccatcagcccaaaaacagttttgtccgcaagttcatactgaaccagctggaaatcaagaggaacaatatctattccctttttgaagaaaacccgaaagaaagctatctggctatttgagggagcggggaatgaaaaagaaaaataaagagagtaagattattttcctaattttactcattctattcacggtgttcctgattcttccggtattccggcttctgctgaaatcattttggggagaggaagggcctactcttgcccattacagcggcgtaattttttccggcggattcgggaaggcgctgggaaacagttttcttgcggcatcggtcagcgcgctgataaccacaatcctggccttttttctggcctatacgatcaattataccaatattccccgttggatgaaggggatgatcagggcggcggcccttcttcccatgtttcttcctacgattacctatggatttgcgatcatatattccttcggtaagcaggggcttcttaccagactgttcggcagacagctgtttaacatatacggccttaacggactgctggtgggttatgtgatttataccctgcccatagcgttcatgctgattcataacaccatgggttacatagataaaaaattcatgattgtatcccgtgtcatgggagacaatggtttttccacctttatgatgaccatcgtaaggcctcttctgggaacgctggccgcttcttttatccaggccttcttcctgtgtttcacggacttcgggattccggcctctgtagggggtaaatatgaggtgatagcctctgtcctttataatcagatgctgggaagcattcccgattttgcaaggggagcggtggtggccatggtgatgctggtgccttccgtaataagcatagcggtgctgcagttcctggaaaaatacaacgtgagatacagcaggatatctactatagaaatcagccgccacaggctgcgggacatagcctgcggtggtgtaagcgccgcaataatcctgtgtgtattgtctgtttttgcggttattttcattgttccctttatatcggaatggccttatgatatccggtttaccatggatcatgcagtcagtgttttggaggatgacgctctgtccggggtggtgaggaattcacttgtggcagccctttttacggcagtggcgggaaccctggcggcttatggaagcgctttggtaacggcaaggagcactgtgagtaaaaagctgaagaatgtgattgaaggaatcgctcttgtgacgaacaccattcccggaatggtaatcggcctggcttttcttttcagcttttccggcactccggtccagaatactttttttcttattgttgtgtgtaatgtggtgcactttttttccacaccgtatctgatgatgaaaaactccctggctaaaatgaacgcatcctgggagacaactgcaatgctgatgggggattcatggataaaaactatcatccgtgtggtaacgccaaatgcggtttccaccatactggaagtattcagctattatttcatcaacgccatggtaacggtcagcgccgtgattttcattgcgggtgcaaggaccatggtcatgacgacaaaaataaaagaactgcagtattttaacaagtttaatgaagtttttgtgttgtcattaatgattttgtttatcaacctgattgccagggttctttttcaggctctggcaaacggcaggataaaaataaagcagaaaatgagggagtaaagatgaaaaaatgcaagagacttgcggcggtgggattagctgcggcagtggcgctgtgcacttttacaggctgcggaaaaagtgcggcggatgaaaaagtgattatttattccaatgcggacgacgaagcggttacggccatgaagaacgcgctggataacaatggtttccgggatcagtatattttccagtccttcggaacctccgaactgggaggaaagcttttggcagagggaagcaatattgaggcagatctgataacgatgagtacgttttatatcaacagcgctcaggaacagaataagatgtttaaaagccttaccttcccggtaaatactttggacgagtttccttcctattgtgcgccgattaccgctcaggaaggggcaattatcctgaatacggaaatgatgaaggaaaataatcttcctgtacccgcatccataaaggatctggcgaatccggaatatgcgggcatgatttccgtgacggatatcaattcctcctccacagcatggctgctgattcaggctctggtgtccgaatatggggaagatggggcgaaggaagtcctgaccgggatttatgccaacgcgggggatcatattgaggattccggttccgcacccttaaagaaggcgagagcgggcgaggtcgctatcggtttcggattacggcatcaggcggtggcggacaaagcctccggtctccccattgattttgtggatccggcggaaggaaatttttcccttacggaatcggcagccgtagtggacaagggaacacagagcaaccccaaagctatggaaatggcagaatgtattattaataacggcagggcggagctgcaggcaacctatccgatccccctttatgagggagaagcggaggatacggaaaataaatcaggcaatcccagggtttttggagagacgctgacctttgaactgctgaaaaaacatcaggaactgtctgacagctgtaaacagaaataatccgtaattgtgaaggtacggaatatcacaataaaactacatattagtagtaaaatggaaatggagaaatatatgaatcactataaattattaaccccgggcccccttaccacgacggatacggtaaaacaggagatgctgtttgaccattgtacctgggacgatgactataaaaaaataacccaggaaatcagggcaaagctgttaacgcttgccggagtatccgataaggattatacagtggtgcttatgcagggaagcgggacctttggcgtggaatccgtgcttaccagtgtgattggcagggaggataagctgctcattgcctcaaacggcgcttacggggaaaggatgggagacattgcggagcatgcttcgatttcccgcctgatatataagcaggattatgataaggttcccgatccggaagtcatcggtatgctgttggaagaaaacccggatatcacacatgtttccatggtccacagtgagacaacctcagggattctcaatgatattgcggcggtggccagtgtggtaaaaaaagcgggaaagactttcattgtggatgccatgagcagcttcggcggtgtggatattcctgtgggagagctgggaatagatttccttatcagcagcgcaaataaatgcatacagggggttcccgggttttccttcattattgcaaaccgtgaaaagctgatggagagtcaaggcaaggccagaagcctttccctggatctgtatgatcagtgggagactatggaaaaggacggaaagtggagattcacttcacccacccatgtggtgctggcctttgccagggcgttggaggaaatggaagcggaaggcggcattgaggccagaaaccgccggtatacggacaataaccgtctgcttatccgaagaatgaaggagatggggatttccccttatatcggagaagaatatcagggcccgattattaccacctttttttatccggaaaatcattccttcaccttttctgaaatgtatgaatacatcaaggaaagaggctatgccatctatcccggaaaggtgacggaggcggaaaccttccggattggaaatatcggggaaatctatgaagaggatatcaataaactgtgtgatatcctgggagaatttcttcagacaaaggagaaaagagcggtatgaagaagctggaagcggtaatttttgactgggcgggaactacggtggattatgggtgtttcgcccctgtacaggctttcgcggaggtgtttaaagcattcggaatagagccggccatggaggaagtcagagagcccatgggaatgcttaagcgtgaccatataaaggccatgcttgccatgcccagaatccgtactttatgggaagaaaaatacggaagaccatctgaggaggcggatattgacagcctttatcagatgtttgaaggaaaattaatgagtatcctggagaattttaccgatattaagcccggcgtattggaaacggtgaaggttctgcgtgaaaaaggaatagccattggttccacaaccggctatacggacggaatgatggaaattgttgtgaaaaaggcggaggaacacggctataaaccggatgcctggttttcgcccgacagcaccaataagatgggaaggccttacccatatatgatatacagaaacatggaggcctttgcggtttcctctgcggatggagtcgtaaaagtgggagatacggtttctgatatcaaggaaggaaaaagtgcgggtgtcttctccataggaattatcgaaggaagttcggaaatgggattgagcagggaggagtatgacagccttaccggggaagaaaaatcccgcagggcggcactggtcactgcgaaatatgcagaggcgggagcggatgcggtcattcacaatatgtgggatctgattccgctgcttaacaatatatttatcatggaataaaaaaatatcaggctgaaaggaaaacatcttcaggcgccctgatttgagagcgccagccacgcggaaatcagcacgccgcagcctaccggtcagatgtccggcggccttcaggagaacggcgtttcctcttcttactccgcttcatgagaaacagcaccagaagaagggaaagaatattggaaaggacaattcggagtatctgaagctcgtcagctccggtatctgtgacaacatgtaaagaattactgataaaattgttgaaaaaatgttcaaagatcccggtccagattgttccggtgagagtgacacagagaccccattcaaaaccgagaattccggccagtatgatataaccgatgcccatgaggaaggcggcccccagcgtgaggctgccttctttgaaccatacggcaacgataacaaggtgccagataccaaagagcagagcctgaatgaagttggcgctacgggtggaaaaagccctccggcccagcttgaagatcaatccgcggaaaagtccttcctccgccgtcacattgatcacatttccaaggatacagatgagaagtgcggaaagggagatgccggtgactgtttgatcggagagtgtgaagttagaaatataaaaggaaagccgtggtgattttcccatgaaaaacagtatgaggaattcggcaagataggatactgcaaaggtactgagccctaaggaaaatccgagaataagccccttttttatgccctttagacggaaaccgatgcttcgccaggagagctttcgctccacaagacattgggaaatgacaaggatggcaaaaattttgcagaagatattttccgccaggaaggtttcatccgttttgagcacaaggaattcaaaatccttggcggcggagcacaatataaatacgaataaaatatagaggattgagcgcttttgttttctggttatcataccggctcctgttccgatactcctaacagcttctttatctgatgataaatacctgtgagcatctcttctgtaattggcatcacttcactgcacattttcactccttctaccataaaaaggacagcagaagcggcttctcccggctcttccaaatggaattctcctgtccggattccataagcaagaagcttaaggaggagttcttttccccgttcatactgggctgacataaaggaaggggattgcgtttcccggttttccaggcagtattcatagatagcgccgcagagtcccggtttcctgtcctgtacttctcccagttcggaaagcaggtaatccttcagcagccttccggcagagatatttgtctccattccttccttatggtgaagccttctgtcctcctggaagctttgcagcagatcggaaaaaagggaggacttatccttataatggcggtaaagaccgcctttgcttaaaccgctggcccggcagatatcctgcatagtgacggctttgtacccatgccggataaacaggggacaggcgctgtccaggatatgcctgcgggtcagggtacctttttcacccatgggcaacactccttttgaaaagcgactatgtggtcgcttttcttttattatagatgccgggaacataaaagtcaacctggaataataaagttggggtacggataaaaagttctttgacatgcagaaatgcagtgttgacgggggattgcggatgttttttgaaaaaatgttatctgtaaatcgtcattttgccaattgccagtcagcaaaaggtccgttactataaaggaaaagaaagttcttttcctttaggcctgatttgtatattttcattttcggtgcagaatctgctgcgccattgattctatttgctgccagggggagttccctgcagggcagtgatcttaattgccggttcggctgctttccgtcatccgtatgctcagctcttttttgagtggtgttctgctttgaaggatggcagatatgcagaaggtattctgtgccggtatctgttaaaggaggcatatctgtgcaaaaaaagaagggtatgaatgtgaagggaaaacagctgctcaggaagccggcatttttctgtgacttgataaacggaggactttttaacggcagacagcgtattttgccgcatatgctgaggggaatgcctgaagtattagggtacagttctgatgacagaggagaaaagcagatccatctggaaagaataccggatgttatttacgctgcagggaatgaagaggattatcttctgcttatggatgagaaccagcagcagacggatttttccatgcccttaagaaatatgcttaatactgcccttgcttatatgcagcagaaaaagcagatagaggagcttcacagacaaaggcatgatttaaaaagcggaagtgaatatcttagcgggtttgcagagcaggacagactgcatcctgtgatatgtattattttttatcatggggaaatcccgtgggagggaggcacgagcctttatgacatccttaggtttccggctggatttgatgatatgaagcggctatgtccggattttcccatgaacctgattcatgcatggaatgtggagccggaacacttcagaacggagctgagggtcgtttttgagctgctgccccatgcggcggataaggaaaggcttcaggaatatgtacgaagccatccgcagcatttcagaaatctgacggcagaggaatgcgacatgctggaggtatttatcggaatgaaaaatctgggggaaacagagcgggaaggatacaggaatgacgaaggaggttacgatatgtgcacagcattagtggaattaaggcaggaaggccgggaagaaggcaaactggaaggggaaatagtgaaaataatatccatagtcaggaaaaaactccggaagggtaaatcgctttctgtcattgcggaggaattggaggaaacggaggagacaattgcaccggtttttgaattggtaaaggcttatccggatacttccgatgatgatatatatgcaatgttaggaaaatagtgccggaaacggtgcacaggcccttatccgctccggatgtaattctgatccggttttgcctgtgggtaaagggtctgtgcagacaggtatatgtcatggagagtgacggcagcagtctattccatataaccgcccctcatgggagaaacggcatgctccgaataaattttcagtacgccctttttatatttgggctctcttggctgcagctttttcctgcgttcttccaggatctgctccacctctttggcagaaagctcctgaccttttataccgatgatttccagaatccgtgccgggatatcgatatggatgagatcgccttcttccacaagggcgatagggcctccctgggcggcttccggagaaacatggccgatagcgggacacttggaggctccggaaaagcggccgtctgttatcagggcaatggattttcccagctccggatcggaagaaatggcttccgtggtgtagaacatttccggcattccggagcctttaggaccttcataacggatgaatacggcgtcacccggatgaatgctgcctgacagtacggcggcaatcgcatcctcttcacagtcaaagggctttgccttaagcactgcctggaacatttccctgggtacggcggaatgctttaccacggagccttccggcgccaggttgccgcgcaggacagccacggtgccgtcggtcccgatgggattgtcaaagctgcggatgacatcagcaggttttaaattccactttttcagataggaatgacacgtctcataaaatccattctgtttcagctcttccagattttctcccagcgtttttcctgtaacagtcatgacatccaggtgcagcatggatttgatttcttccatgacggcaggaacgcctccggcatagtagaagaactgggccggccatttaccggccgggcggatatccagcagataatgggcgcccctgtgcatgcgatcgaaggtgtcgccgtcaatttcaaagcccagttcatgggccattgccggaatatgcagcagggaattggtggaaccggatatggcggcatgtaccatgatagcgttttcaaaggacttcatggtcacgatatcgcttaccttaagtccctgtttggcaagctccattacctgtaatcccgctttataagccatttcctttaattccggacagacggcgggcatcagagcggagccgggaagcatcaggccaagtgtttccgccatgatctgcatggtggaagcggtgcccataaaggaacaggcgccgcaggaggggcaggcattgtgcttataataggtcagcttttcttcagaaatctcacctcgctggtacatggcggagtaagcgcctatctgttccagggtgagcagatccggtccggcatccatgacacctccggtgatcacgatagaaggcatgtcaagtctcgccaggcccatcagacaggcgggaacggatttatcgcagcttgcaatgaaaaccccgccgtcgaagcctgtggaatttccgtgtatttcgatcatattggcgatcatgtcacggtgtgccagagaatagttaattccgtcatgtccctgagcgattccatcgcagatgtcggtagtataatacctggcacctcttcctcccgcgtcttttatcccgcgcatggcctcttccacaaactggttcagatgcgcacttcccgggtggctgtcgccgaaggtgctttccaccatgatttggggcttctccagatcggctgccgtccagcccataccgagctttagcggatcattttcaggggccagggccctgacacgctggctgttccattccttcataaattattcctcccatttagttgttcttttgttattcgctatatgctgattctgacagaatcaagacatcagatgtcttactgtatttatcctatcatttccctgaaaacagaacaagtcatcctatgtacattctactttttgctattattatataaatccggctggatgaatttcacaatttattatattcttcagccgagaagaggagaaatttctttgaatgataaacaaagaagaacaaagtcatcagatgatttcggctttgttctccttgtccacagcatattttgtgtttcgcatccataccggtttgaaaatggaagaaatattcttacggttcttctctaatcagccttttaatcagctcccgattataggtcagatgcatcatcattgcggtttttgcccctatggtatcatgctctgcaatggcatcagcaatagcccggtgtgtgcgtacggtttcatcggtaagcttttgatgggttatatttacgaacatcaggacggcagtgtcaataatgggcaccagctgttttaccactacattgcgggagcattcggccacgcaggagtgaaaagcaatatcctcgtcaatataactgtctccgtcattgatccgtttctctatcttcctgcacaggagatcaagctttttcacatcctctggggaggcatgaagcgctgccatttctgcaattcccggctcaagcatgatacgtacgtcaaccagatcgagcgccagcgccattttatcctccacagcccgcaagcccagaggatccagatctgcgggtgtggtactgattacataggttcccgaaccctgccgtacctccaggacttttctggaaacaagaagttttaccgcttcccgtatagtactgcgccctacgccgaatttttgtcccagttcgaattcattgggaagcttgtttcccacagggacaggggtactcaggatataacggaaaagctgatcctgtacctgctctgccagaagtttgctttttaagttggaaaattcgtccatgttcttattccctctgtatcatttatgcttttcccgactggaagaatgctggatcagcatctgtatccgggtctgcagctgcagtccgtcggaacaggaggcctgtatccggcagccttccggagcctggatacaggctgtaagagtactgccgctgcgggtccagcggatggacaggagacctcctgaaacaggaagggtaccctgacattccgtgagggggaggtcatggaagaccagtcggattctattattttctataccggcaacacccagaatatcacgatagaagcaatgaaggatatgagaagcaaatccgtggttgcagctggcgtaatctccggtattttcccataaagtgcctgttttcaaagccatgtagtcaaagtattcccgggactcctttaaaagctgggcaggccttcccgcccttgagaggagttccatgcgcagataattgccgataaaagcatttgcgggccagatttggggatggagtccccgggctgtccgctcaggtccgaaatcttccagaagacggttaaagagatccgggtaatcttcttgttcggctgtcctgaaaaagaacgcataatattgacagacctccgttgcatcagactgtctgaccagcctgccgtctgcacgcagcgcatgatcacagaaccattggccgtcaaaggactgctcccgtattttacagcggatttgaaagcctttttggcggtattcctcctttttatacagcctggcggctgcaagaagggcggcgctgtaaagcatattggagggataattgactccgtccgtgagttcattggctttggaccattctacaaagacccatccggggatgttttccagcaggccgtcttcattttcatagcgggccatgaaagccaaaatgccgtccacacgtttttgtaaagcagggatcagggaactttggggacttctgccctggtactcgtacagttcaaggataaaccaaagcgcccagttggcgatatatacaccatcaggatggtcggagggataacacatgggtatcatcccttccggaagatatgggaactgttccggaagcagataattttccaggaaattatcttccacaagatggtttccggtcagatccatttccacccgtgcggtaaaaaagctgtcgcacagccagccggcccgttctctggatgggcagtccatgtaaagatcgggggcattttgtgcaaaggtttccctgcctgcttcaaaaatccggttaagggaatcatcgcaggctgaaaaagatgcctgggaaactgcaggatttttaaattcacggatatagatatcccggatgttaacgctgccggaaaggaccatgggcttgagataacggcaggtatatggctggatggtttccagacagtattttccgggtttcagttccaggctgacggcattgacgcaggacatccggttataggagacgtctccattgaggaggacctcatcaaaggtgatatataccctggatgcctgtgtgcattccaggcagataccgataaaaccggtagtattgcggcccgcgtcagctatgaagaagcaatggtcggagagggccgctccgtcaccaggagaagacggagtctgtccggaggtgagggaacagaccgaacagctatccatgacgagggataccttttcctccagttcatccaggggaaaaccatgaagagtatctccgatttcaaataaagaacgatcctgccagacgggaagatctgtattttcggaatcaaaggtaccttcagcgataatttggtttatttgaagtactgggaaatcaggccagggaaccctcctttccagaagctgtttatcctcctgtctgcaaagaggctctccggatccgcaggtaccttttttccagtcatcgaaaccctcttccagacggaaagcttcaataaaaggacgctggaagctgtaacgctgtactttctgaagacgctcctttaatatatgggccctgaaatcaccatctgcgtctgtaaacctgattactttattatcacactgaagctctgcctgcagaaaacccggctgctccactatataaaagctgtttacataaaaactgatcacttcaatggtcagaatgttattctcctgcagcaggtcggaagggattgctatgcgatccacccggaaataaccatgtgcagccctggcgggaccatgaccaaggaaacttccgttcaggcaggcccggtatataccggatgaagctatggacagcactaagttattgccggaaagctcccgggagttaaaacagcatataaaaccagctccgcagttcttttctttttccctgccggtcagccagaccggtcttgcatttttaaaatatgtcatatcataactctcctgtctgtgtccggcatgtgccgggatcgttttgtatgtatgcaatgggcggattgtccgctgcatggtatgggatcagtatagcatatagtacggagacatttaatcagtaatttggtttccctgccaatatatttttccttttcttattgtaacttttatcatcatattatgctataatctaggaaagcttttgtaaggaaagaattccggaactgctgaattgtcaggaggggaaatatatattttttataatactgaagggaatataaaaaaggtttctcaaggggctgaaatgagactgctgaaaaaaataacagacatggaaatattaaataaagaagggataacggaagcagaacccagatttgccgcaagggctgtcatggttaatgacaataatgaaatcgcggttatgtattcacctgttttccatttgtattctctgccgggaggcggaattcaggatggagagaacaggcgggaagctgtgaagcgtgaggtattggaagaaaccggctacttgtgcgaaatagtccaggaattgggatatgtatatgaaaaccgggcacattgtgattttgtacagtactcatattactatgttgttaaaacagcgggactgcaggggcagactaatctggaggaagatgaaagaaaaagcggaatgcatgtacagtggcacagtctggaagaaacgatcagattgataaccgatccggtacatgataccgttcagaaaaaatttattcaggctaaagataggaccgcattggaggaattcctccgagtaagaaagactgattaaaagctgctgtcatgaaaagggggaaatgattatgccatgtcctgaaaagttcagagaatcacttataaaattcgatgtggatgcatccataattgaacagatcaataccggttttgaacaggtagtaagcagtactccgaaaaaaattaaggcttcctattttaagcgtgctgtagacattatggatgaaaaagtggatgccggaaaaaagagggatatactggactggaatgcgtgctgtaaaagcggttccagggaaaaagcatccaaagcctttgcccgtgaaaataaggaacttccgtggaaggaaagactggctaaaataagtgaagaagactatatgggaacacctgtattaaatgaggacggcacgattaccgttcatgcggtatattacagggatggagacaaatatgcatgttcctgccctaatttcaacaaattgaaaagggattatcctgtctcaaagacctattgtttttgctgcggggggcatttccgcttccattatcaaatcatgctgggtttgaaattgagagtgaaagaggtggtttcctcaccattgaacagtgaaggggaaatgccctgtgtttttattatggaaataataggataaatgatacggaagggaaaagaaaatgaaatttcatgagttcggcagtaaaaaaaatccccacattatgctgatacacggagggggaaacgcatggtggaattatctgcgtcaggcgcgggcgttaagtgatcgttatcatgtgatacttccgactctggacggacacggggaggaatatgccctcacttacaaatccacggaggattctgcggataagctgatggcttatattgaagaaaaatgcggaggacatctttttgcgttgggaggagtatcgcttggagggcaaatcgtgatggagctgttatccagaaaagcggatataacccggaaggccatcatagacggaagcctgtgttttccgcagccgggcatggcgcgttactgtatggctgttatccggttcggcagcaggtttatgttcagtgaaaaggcctgccgccgtcagatcaggtggatgccgaagctccttccggccaaaatgcagtatcctgaggaaatacaggcatattatatccaggacatgccgcgcgtcagaatggaatctctggaaaatatgtaccgtacttatatggcggagtacaggctgaaggatagtgtcagggatacggccgcggaggttatgtactggtatggggaaaaggaaatgaagtgtgtaaaggaatcggcgcgattattccaatcctttgtgccgtcctgcagaatatatgaagcgaaaggttataatcacggttatcttgccatttatctgccgcaggaatggctggctgtggcagaacctttttttaataaggttgaagaatagtttctgttggtttgcccatactattcctgaggtgagaaaatggataaagacaagcaggaaaaaataaaccagaagaaaaacaatgagaaattcaacagcataacacaaaaagtgaagccagagaaccagaaccagtcgcataatgtgcgttccgaagcggtggagcccaaaatccggcaggtataagcatccttaagagggtgctttttctatgtccttttatggaggaaagtggatatccgcctgaaaacatagtataatgcctgtatggaaaaaagatttttaaaggggaatacatatgacaaaaaaggaaaaagtaactcacgttttaaatatgctggataagacatatggaacaacgaaggagggcttttaccataaccatgactggcagctgctgacagctattatgctcagtgcccagagtacggataagcaggtggatgaggcgctgccggaactgttcgggcattttcagaccgcgcaggctgtggcggaggcgccggtggaagaaattgagcagtatatccgttcggtaggtttgtataagaataaagctaaaaatattaaaaaatgctgtgagcagatcgtcagtgaatatggcggaaaggtgccggataagctggatgaggtgcttaagcttgcaggagtcggaagaaagacagccactctgtttctggctgatgcctatgggattccgggggtgacagtggacacacacgttttccgtatttcccgcagactgggctgggcggagggaaaaaatccgcagcaggtggagcaggagctgatgaaggtgcttccaaaggagcactggaaccggataaattttcagcttatctatctgggacgggcaatctgtacggcccggaaggcacggtgtcaggattgcccgctgcaggaatggtgtgaaaagaaggaagtcgattaattatgtattctggggggcgtcggaaagctgagaaagaatggaacgaacatcgtcccccattttaatcatagctgcggtggtgggatattcgatgccgtggactagcccgtttcgggcgttccggagagccaccaccttatccaggctttctttgctgagtactttcatccgtttcaggctgttgacattaaaggtgcctctcgccttgggattgcttttcagagtgagacggcccagtacggtttccaggctgatccagggcttcatgaaatattccatggcctggaactgatcctttgccagtttctctccgggagcgcgaagctcgcggtagaggtgatagcgtttttcatttccgcagattatctggtcaatgagctgctccgtgatggtgcgtttgtcgttaaccagctttgtggatttcagaatcggttccagttcctttacgttggctattttcagccgtcccatcagacgcagcagaagttccacattccccatacggggttcgatatcaaatcttttgtatcttgtactcagatagttatacaggtaagccgccagatcgtattggttattgaatgcggtatttttgctctgaattctctcgtttccggcggcctgaaggcgttccagggcgatttcaccgctcaggaccagcccgttcagctcatccaggatagaaagctcctcatcggaaagagtaccctggagcggcttataaaccagatcatgctccacctccgaccaggcatgcatcaggacggatgccacctgtatttcaagacggaccggcgcaaatttcagcttgcttttttccagggattcttctttcatgctggcccgatagtgtgtggcccaataaccggaaaaacgtttattataggaaggctgtttggactggaccggaaactttttcgtctccgccactgcaaaaaggttgttgatgactctgtccgcttttgcccggtcaccggggaaataaagggagacgcgcacgccggaaagatcggcgatatcagcataaatttcacccatattcttatagggagtttctcgtttttcattccgctgggagaccttgattttcagccttccggggcttttggcacgggatgtcaccatggcgcggataccggaagaacgcagggaatcgtccagcatatcggccgcaatccgtccggcggtttcataaaattttatttttttcttatagttttcaataaattgattaatcagatccatttctgtttgcctcttgttcttttggcagggtattccgttaagtattttacagcccaattgtgggaaactgccccttcatcctatcacaaatataataaaaagtacatgatttaaacgttcttatacagatctttatagaatcttaatgggaactaaataaagttttatttttcatggggtatgattagaatacagataacaaaacgcagccttcgcacacctccggtcactgctttcgggactgccgcccggattggctttccttccctctgcgccagccgtgcaggaatccttaaaggggacgcttccgctcggataaacacgcagcggtactaaggccgcaaaatacgcggcctaaggaccggcgagtttatacgccccttacaggaaaccctgcacggctggcacagagggaaggaaagccaatccgggcggcagtcccgaaagcagtggccggaggggacagggacatgtgcgaaggctgcgtagccaaatatgtatgtttgatatttgaaggtttagacgggaggatatttttatgctgtttttgatggatttggcgattggcgccggcagcgggctggtgctttcggttccggttcttttatggctggagaaaaaaatacagaagaaagaggaaaagaagccctggcatacggcaggcgtgctgctgtttgcgtttttgctggccggaatcattacggtaacaggggttcctgctatataccattttcgttttgacgcgaatatcaatatgattcccatggttgatatttttactgatttcagccagtattttaaaaatatgcttctgttcgtgcctcttggttttttgcttccgctgctttggaagagggaacggctggtggaaaagacagtgagtatcgggttccttttttcactgttcattgaactgatacagctattttcattccgggccaccgatatagatgatttgcttatgaataccctggggacatgggtgggatatctgttatttaaagtgattttgaagataatgcccgggctgtgtgaacggttcggagcgggagaaaagccggaagaaggcagtttatggggggaagaggacaggcagaatggtaaaatgacagaagagcgggaggaatcccccgccgcccgctatgaaatggagctttgcttcggaattatcctttttcttatgctgaccctgcagcccctgctgtcaggggctttatgggagcttttgtatcattaagacgggaggcggaagatgcggggattaaaatacccgggtagtccatttggtgcagtcccatacatcggtgaccagatcttcataaaattccggttcatggcataccatgaggatactgcctttataggccagcagagcccgcttcagttctgccttggcgtccacatccagatgattggtaggctcgtccagcagcaggatattggtttccttgttgatgagcttgcacagccgtacctttgcctgctcaccgccgcttaagacttttaccatgctctcgatatgctttgtggtcaggccgcattttgcaagggcggaacgaacctcgtactgggtaaagccgggaaattcctgccagatttcctcgatacagcttgtggagatatcagggggcatttcctgctcaaagtaaccgatgctaagataatctccctgttccacgctcccggagaggggagggataaggccaaggatacttttcaggagagttgtctttccgattccattggctccgatcagggcaattttttgtcctctttccatggacaggttcagcggcgaggataacggctcatcataaccgatgaccaaatccgaggtggtgaaaatatagcggcccggggtacgtgcttctttgaaatggaattccggcttcggtttttctccggataattcaatcacatccattttatccagctttttctgacgggacatggccatgttccttgtggctacacgtgccttattacgggccacaaaatccttcagatcggcaatttccttctgctgcttgttataagcggcttccagctgggattttttcatggcatagacttcctggaatttgtcataatcccccacataacgggtcagagcctggttatccatatggtaaatcaggttgatgacgctgttcaggaaggggatatcatgggaaatgaggatgaatgcattttcatactcattcaggtagcgtttcagccattcgatatgttccgcatccagatagttggtaggctcgtccagcagcaggatatccggcttttccagcagcagcttgccgagaaggaccttggtgcgctggccgccgctcagctcagaaacgtcacgatccagcccgatatcggacagccccagggcgcgtcccacttcctccactttggagtctatcatataaaaatcatgcatggtgagcatatcctgtatggttcccagctcttccatatacacgtccagttcttccggggaagcttctcccattttctcacagatttcattcatatgagcttccatttcaaaaaggaaggaaaaggcggaagccagtgtttcacggattgaggtgcctttttccagcaccgtatgctgatccaggtagcctacccgtacatttttggcccactccactttcccttcgtcgggctgaagctttccggtgattatattcataaaagtggattttccttctccgttggcgccgataaggccgatatgctctcccttgagcagacggaaggatacatcatgaaaaatagccctgtccccaaaaccatgggaaaggttttcaacatttaatatgctcatgcaggttctcctattgccggggtatcttggttacggccggcagaaagccagccgacgcaagtataccacaagaacaccgcattttccagatcttttatacatcagcctctattcagcttacattacccgcctgccctgtgcttggtgcctcccgacggccggttcgcctccccgcttgggatttccctcccggcaggtctgtgtaccctgcgcaggcacgttctcactctgccaaaaacgcagcggtactaagattgcaaaggacgcaatctaaggaccggcgtttttagaaggcctttgcagggtacacagacctgccgggagggaaatcccaagcggggaggcgaaccggccgtcgggaggcaccaagcacagggcaggcgggtaatgtaagtgctatctaatccggattggaaaagcgttcccatttacggaaggtgatgaagcacaggagggctcctcccagggcgaccaatacccagactgcgatggtgtaaaaccagccgaagcgttcggagatagcgccgaaggcataggtggagagagagcttcctatgtaagtggaggcgttcaatatgccggatatggtagcaacccggccaaatctggcaaaatgccggggaacccggctgatgagcagcagattaataccgtacatacagcctgtgatgagggtcatcatcgtgatgctgaacacgggcagggactggtaaaaaggaagcaaaaggagagaggaaagcgttcctattacaaaaaggatacccgcggtaaaaagctcattatgcagtttctgcagcagccatgaggcgatggtgatgctgaaaatactgaaaatcggaagtactgccgttgtgaggatggacagggaagtactgagtccgaaggtttccgtaatataagcgggcatccaggtggtaatcccgtcccggaggatcccatgaaggataatggccagaaggatgggaatgagggatgcctggagaaacagggcaggcagttttattgtatagtccgtttccatttccacatttaaggcggaaaccgtgttggttccgtcagactgcagtctggtaaagctcagcagccagaaaaaggccgtggcgatacctaaaaggccggggaaaataaaagccagcctccagccggaaataaatatacagacaggcgcgaggacatatacggcgatcattcctgcggaggaggcaacggatacctgtacgcagcattttttataatgctcttcatccaggccttctgccatcacacgtacgagcggaggccagagcatggactgaaaaaagccgttgaagcaccagatagggatgatgacttctatccggggaaaaagagcggccagcagattacagacagaggtggccgtcagtccggtaaaaatcatatcccgggggtggaaacggtctcccataaagccgcagagaagctggccaattccataggtgataaaacagccggtaaccggaagtccggccaggcttttgctgatattcagggaacgctgaacctcagcaaggcaggcagcataattcagacgggtgaggtagctgacaaaataaaccaggcagcagagaaagcttaaaaagcggatatcacgcctggaggttaaacgattgatcatatcaggctttttccctcccattccctggcgggtaaggttcctgaaagccgggttattgtgggggcaatatcacagattccggcctgctcgaaacgggaaccggggcagaaatccggaccgatgcagataagggggataagcatatcttctttttccagggaaccatgtgtacggtcgtgccctccgtgatctgccgtgattataattgtgtattcatccataaagctttccgtgagcttttgtatttcatccagggactggcggcaggccttcagatattcttcgcccatccagccatactgatgtcctgcgctgtcggtaagccccaggtaaacgaatgcgaaatccggtttttcttcccggataaaggaaagggcgttggcggttaccatttcatttgctttttcataggtatatacgcttccagatacaaaatagctgtaagcgagtgaggaaggacggcttaagtcccgcagctcttcccaattatagaaaaaagcacaggttttaccggcggcgttcagctgctcacaaagcccgttcaccggacgtacctggggaacataggtgttggtgaggatgccgtgacggctgggatcaacactgtggaagagggacatgtggcaggggagtgtaacagaaggataaaccgtttctgtttccaggcaacagcagccaagctcggtaagacggattccgtaaggatggccgcaggctgccagagcatcgggacgcagtccgtcagccaggatgaggagtacttttttattcatggttcgacctttccgcctgcgtaccgcaggacttttataatatgtatcggccctgatgaaaggggcgtcagcatttcgtaatctgaagtcctgcttttctgtaggcttcggctatttcgtccggcagacccgaatcggtgaaatagaggaaacggggattgagatcgcaaaccttcagggctgcacaggtctcaaattttgagctgtccgcctggacaatgatctgatcggaaatagcaatcagtgctctctgtaccgctatcatttcatggatatgatcactgatgccgaaatccagggagacagcggaaggggccagaaaaaatttggatacatgcagctgctttatcatgtccagcgccagatgcccgtagaaggttttttcaccgggcatataaaagccgccggtcaggatggtctgaaagccttccttgcctgataaaatctggaatacctccagggaattggtgacgatggtgagcctggaaaagcgctcacacagcagggaagccagctcaaaggaggtggaaccggtatcgagggcaattctgtcttcctcatgaataaagggaagggaagccagcgcaagcttcctcttttcctcccggtgttctgaaacacggaaggaaagactggtataattctgcattttatgaacggtgacggctccaccgtgcaccctctttaaggccccttgtttttccagatattccaaatcccttcgtatggtttccagggatacccggaaggtatcggtaagttcattaacggttacggaagagcggcggttgagcatttccgtaatttgtattcttctttcatttgcaaacatatacaattatctccacataaacacaactgtttccacataaatgtatcatccttccacaaaactgtcaagatgtcatgttaattctaagtgaaactttctttaagattttatgtattttattgtaataagaagaatatgcgtttattatgagtggaagctggaaagtcagacataagaaaaagcgctggaatgcgggaaatacaggatttaagcagagatagaaaggagcagatatgaaattcagagaagacggaacttttcatatattacatataaccgatattcaggaaataccggaggtggcggaagacacattaaccctgatgcgcagggcactggatgcggcgaagccggatctggtggtgttcacaggagatcaattaaagggatacagcaaaaaattccgtaaaaaacccgggcaggtggaaaaaaccattaacaggatcatggagcctgtcgtcagccggggaatcccctttgcggtaacctttggaaaccatgacgaacaaagcgggatgaccaatgacgaacagatggagatttaccggaacattcccggatgtgtggactggctgaacagccgcggacaggaaatccttcatgggacggaggaggggacttttgccgtcggaatccggaattttgaagaaacgcagaccgttatggcggtttatctcatggattccaggggagacgctcccgggggcggataccagacgctgaatcccaggcaggtattctggtataagggcgccagagatacctttgagcaggaacacggcagactgattccggggattgtattccagcatattcccatgccggaatattaccggctgctgaagaagacggataagaagacaaaaggggcggtacgtacctaccgtacccatgccaatgaatattatgtgctggatccggaaaagtaccggagcggcagcttcaaagaagcggtgagcattcctgataataacgcaagggaatttgagagtttccgggagaaaggggatatttttgcagtatactgcggtcatgatcacaggaacagctttgtgggaaactgcggcggcctggatttgggctatacgccgtcatgtggtttcaatgaatacggcgacggtgtgaaccgggcggccagggaatttattttccatgaagaggatccttccgcatatgaaacaaggctgcttacctataaagatctggttggagggaagccttcccgtccctttcgggatttcgcgtacagccacatccctgcgacgaaagaggaggctgtggcaaaaataaaaaagtatctgcttttcaccggactggctatagcaggggtgcaggcggtgaggagcgtatataagagaaggaaaaaatagtgatatggaaaagaattataaggtgacaatataaaactgattaaaatagaaagggtattatggtagaaatactttaaataatacggaatgttgacatcttggctgtcaccttataattttccaatcctccccaaacaaatacttcatttcggctaaacgtacaccatttatttccataaaacctgagtcctctcccttatattttagctgataggatgccaaataggagcgaggcagcccggcgatatatccattataataatcggagtgggccgacatgtattcttcacccagacgtttggtgtatgcttccttaagctgttcggctgtgtaataatcggatataacttctccggttacccatgaaatccatccatactcgtctgttgttggatctgctgtatctttaaatctcttttccagttctttttctagttttccgatatgttcttccggacatttgagtgtcatattttgtaagcccagcatgagttctttgctttcaaagaaagacatgcttacttccatactaatgccataaacctggattttatcctctaatgttacccaaaaagtaccatctttttctgcagtctcatcgataaaaggatatatttttttgacctcttcactactcattccccaagtcagtccctcaatcgggggatcccatacattttcttttttggatgattccccacagcctgtcagaagcagtaaagagatggctgttaatataaaaatacaatatttatgtttcatacttgtgcctttctttatctttctgcctgtaataaataaggcccggaggttcatccattcggtcactttattcaaaaatattgacgtctccaaccagccactccatggatacattcaaagcctttgcaaggatacgcaattcagcatcacaaacatgacgctgatttttttcaattctcgatataatcaatttggtcatatcttcaaaccccagcagctggattttcatggcaagttcctcctgcgttattggcggctgctggagtgcccgtcccagtctgacgcgatctgcacatatatttcctttaattacaaacatgctttttgtcaattatgtcacctccggagtatctagtctatatattttatatatttttatttgattttatttcaaaataagatataatactgaatagacacgatataaaatatctagtttggatattttgtaaaaatttttttgttgcaatagttacaagacaaatagtttgagataagggaggatagataggaagttaacataaatatcatacccataccctttggcggatatgtattgggtcagggagccttggaacagatgtatggggaatatgcacacggatatgtgaaaaatgtcgaagtaagacattaaattaattatgtaaagggaggaggaattgtttatggcggtgagaacaaccggggaaaagggaagggttatgaaaaaccagccgaatgctaagaaaagtatggggaaaaggatatctgtggaggtgaaaaggcactggcagttatatctgatgctggttttgcctgtggcctatctgattatttttgcctatctccccatgggaggggcagttatcgcgtttaaggattattccatccggggaggaatctgggggagcgaatgggtgggcttaaaacacttcaaaaatttctttaccacaccggatttcaagaatttaatgacaaatacacttgctctcagtttgtacagccttataatcagttttcccatgcctatcctgcttgcgttggcaatcaatgaaatgcggggaaggcattataagaaagtagttcagatggttacgtatctgccttatttcatatcgacagtagtattggtcgggattatgcagaatattttttcggtccggacagggctggtcaacaatattatcatgctgttcggagggaaagcagttgatttcatgggaaaaccggggcttttcagaagcctgtatgtatggtcgggcgtctggcagggaatggggtacagcgctgtaatatatattgcagcacttgcgagcgtggatatttctcagacagaggcagccattattgacggtgcaggccgttttgcaagagtgtggaatgtagatattccggcaattatgccgacgattgtaattcagctgattctggcggtaggcagtattatgagcctgggttttgaaaaggtatatctgatgcagaatccggtgaatatgcagacttctgagataatttccacctttgtgtataaacggggacttattaatttccagtattcttatgcaacggcagtgggactgtttaattctgtatgtaacatggttctgatagtgcttgcaaatatgttttccaaaagggtaaatgagaccagcttgtggtaaggaggcggctatggcaaagacaataaaaaagaaaaatgcaactgtccggtattatacgaaaccgaaggattacttatatatggcgcttgtccacatattatgcgccgtatctgtaatctgtattatgattccattgatttatgttgtggcggcttccttttcatcaccgaaagcgcttctttccggccaggtttttctgctgcctgtagattttaccttgcgcggttataaaatgcttctgcatcatgaactgcttataaccggattctgtaactcccttttatatacagtggtgggtactgtgattaatctggttatgacggtgctggcggcctatccgctttcacgtaaggacctggctatccggaatccgatcatgcttttattcacttttaccatgctttttaacggcgggatgattcccacttatattctgattaaaaatctgggaatgctggacagtatctgggcactggtggtaccgacctctatttcggtctggaatctgattattacacgtacctatttccagtcaacaattcccggggaagtacaggaaagcgccagcgtggatggctgtgatgattttaccttcctgattaagattgccattcctcttgcaaagccgatcctggcagttaatgtcctgctgtatgcggtaggccactggaattcttattttaatgaaatgatgtatctgagtacaaataccaaattccctctgcagctggttctgcgggagattctggttaatatgggcacggcaggcatgacgcttgatgtaacgaaacagcttgagatgcaggaaacgaaatacctgctgcaatattcaagtattattgtgggttctgtgccggttatgctgctttatccctttgttcaaaaatattttgtaaaaggaattatggtaggagcgattaagggataggacaaacgggggttattattggaacatttcatttttattacgggaatggaatgtttcaaaaaaaatataacaaggaggatttgtaactatgaaaaaaagagtattggccttgctgttatctgcgtgtatggtattgggtatggcaggatgttcgtccgggaaagcagaaaccgcttcggacagcgggggaggtggagcctcagatgcggcgtccgaagctgctgcggatgcttcgggaccggaagggtttaacgctaccggcatgccgatcatggatgagaaaattacgctgaaggtatggattgaaggaggggcggatattgactgggaacagaaccggtttgtaaaagagattgaagaaaaatcgaatatcaagatggatattatttcaacgcctttgtctgatgcactccagaagagaaacctgatgcttgccagcggggattatccggatcttattctgactgactggccaacggtatttacaaagtcggatgttatgcagtatggggttaaggaaggggttttgcttcctattacagattacgttgataagtatggcaacaatataaagcgtatttttgatgagaatccaaactataagaacagttgtatcgcgccggatggggaaatttatggatttgcgcgtttctcagagtgctatcactgcagtgcgtatcctaagatttacctgcgtcaggactggatggatgccctgggactggatatgcctgaaactacggaagaattgagggaagtattaagggctttcgttaacgatgatcccaatggaaacggaaagaaagatgaaatcggaatgatcggcgctactacctggaatacgatggttgaatatgcattaatgggtatgtctttccagaccgtaaaaccggacttctggctcagccttggcgctgatggaaaaacggtggaattttccccatcgacagatgcttaccgtgaagggctgcgttatattaagagtctttatgatgaaggactgattgatggtacttcctttacccagaaggatgaccagatggcacagacgatcaggacagaaccacatgtggttggaatgtatgtctgtgatcatgcgggtatgggttatgacaataaggatcccaaagaagcggagaattatcagattctgattcctgtggcagggccggatggtttcaggcgccagggccagaatgcgtttgagggtgagatacaaggcttccatgcggcaattacagatgcctgtcagtatccggaagcggctttccgcctgattgatgagttcttctatgatgatgattataacatggaacgtatgtatggagaacgggggattggctgggattatgccccggagggaaccaagaatgtatttggcggagaagccagatatgttgtaaattctgtttctgaggatcagagtgcagagattaagaagggcacgatgggtgtggggccgcaggcggatcttgcttctttccgtctttccatgcttccggaggcggaagatatttatcagtccggaaattatgagcagcgtattactcttgatacccagaaagtagagcagtatattccggaagaaagactggattataccgtatacattcctctggatatggcggatgagtatgcggaaatccagacgaatcttaataactttgtccgtatggctaccgttcagtttattacaggtgatcgtgacatcgaatccggctgggatcagtatctgagtgaacttgattcttacagagtggatcgctatattgaaatatataagacggctgccggcagataaatacagataaatcgatcaggcttccggaaccttccggggcctgattgttttttgcggcagcaggcatttttatgcttggggaaaggaaggaacagtattatggaattatggtataaagaaccggcatcctattgggaagaggctcttccgctggggaacggaaggctgggggcaatggtatggtcggggacggatcaggaaaaaatctcattaaacgaggattccctgtggtctggttatccccaaagccatgatatatccggagcggcggaatattatttacaggcgcgccggctgtccatggaaaagaaatatgaggaggcgcaggcgctccttgaacagaatgtgcttggggaatatacgcagagctatctgccgttaggggaactgacgttggatatggcacatcctgaaggagagatacggaattacaaaagggcattggagcttgagaaggcactttccagactggaatattcagcgggagatactaattacacacgtgaaatgtttatcagtgcgccggatcaggttatggtgatgcatatttcagccgacaggccgggtatggtttccctgaaagctggtttttcctgtcagcttcgcgcagaagtgtccatagaagaaaacagaatgattctggatggaatcgctccttcacaggtggatccttcctatattgattctccggatcctgttatttatgaggatgctccggaaaagaagggaatgcagttttgtgcggtgctggagattgatgttgagggcggggaaatgaaaaggctgccggaagggctggaggtaatccatgcggacagtgttaccctgtttctggctgcccggacaagctttaacggtccgttccggcatccgtttctggaaggaaagccttataaagaaccctgcttcgccgaacttcaggctgcccgggaaatgggatatgacaggcttcttgaacggcatatagaagaatatcagcaatattttaaccgggtttccatggatctgggaccgggaagagaggaattgcctgttccggaacggcttgctgactgggataaggatgtggatccggcacggttcaccctgctgttccagtacgggcgttaccttctgatctccagctcccgtccgggaacgcagccggccaatcttcagggaatctggaatcagcatcttcgcgccccatggagctctaattatactgtcaacatcaatacggagatgaactattggggagcggaaacggtgaatctgccggaaatgcatgagcctttattcgatctgattcgtaatctgaggatcagcggagggaatacagcccgtatccattataatgccggaggctttgtatcgcatcataacagtgatatatggtgcctttccactcccgtgggaaaccgcggcaagggtacggcagtgtatgctttctggccgctttcagccggctggttaagtgcgcatgtttacgatcattatcttttctcaggggatttggatttcctgcgtcagacaggttatcccgtcattcatgatgcggcgcgctttttcctggatgtccttactgaaaatgaggatggcgaactgatttttgcaccgtctacctccccggagaaccagtttatttatcatggcaaagtatgtgcagtcagtcagacgaccacaatgacgatggcgattgtccgtgaagtattggagaatgctgcggcctgctgcaggttactgggaatcgatcaggaatttcttgcagaagcggaagaggcgcttggacgtcttccttcttaccggatcggctcacggggcgaactgcttgagtggaatgaagagctggaggaaaacgaaccgacgcacaggcatacctcccatctctatcctctgtatccgggcaggcagatttctttggaggaaacacctgaactggcggaggcctgccgccggagtcttgaactgagaggagaggaaagcaccggttgggcgcttgcctggagaatctgtttgtgggcccgtctgcatgacggagaaaaggcttatgggatgctgaaaaagcaattgcgtcctgtggacggcagcaatcccatgaactatcagcaggggggaggctgttatcccaatatgttcggcgcacaccctcccttccagattgattccaatttcggatcctgcgcaggtatcgcggaaatgctgatgcaaagcacggaagagacgatcgatctgcttccggcgcttccgcgggcttttggaacaggtatggtttccggactgcgtacacgtgcaggagcgacggtcgctgtcagcttccgggacggcaggcttgaaaaagcggagctgaaggggacgatgccgcaggaaagggaactgactgtctgttataaaggcaagaagaaaaaaataatcctcggaaagggaatgccggtcagcttaacggaggcggatttctgacaattatgcgtaaaattttcctgtgaatctcctgtggcggggcaaagaaaatttatacaattgtgtcagaggaattggggaaaagagtatagatttaaggcgctgcgtgaagaaattccgcagtgtcttttttttatttgtaagaaacttgtaagagttttgatggaattttaaaaagatttgtccgttaacatgaggtaacaacaaaaacaagaaaggacaatcgatttatgaaaaaaacagccgtgagtaaaacattggcgctttttctgtcggccgcactgctttttgcgggctgcggcaaaacgggcggagagcaggaaagcgtgggagatatggccggagacggcgataaaaccatgggaagatatgtggaggaagaaataggaagaccggaagaaatggagagaaacggaggaatagtccggcttgcggatggtacccttcagatttttgactttaatcagggcccctttgtgtctcaggatgaaggaaagacctggaccaaaaagtatgatgactggtcaggtatggtgggtgaaggctattttatgaatgcggctgctgcaaaggatggaagcctgttcctggtatacagtacttatgatgcggtgttttctgaggaaggggaagaaggatcacaggaagaggagtctgatgcggagcgctccgaacagccggatacggagccgccggagacagaagataccgaagtacaggtggaagagtccgatatgtttacaatagactgccattatatgtttgtttctccggaaggagagactcgtgagattatgctcccttttgatatggataactatgaacttattacaaactgctggtatacaccggacggcagactgcttgccagccagggaggggccatttatgagataaaccaggaggacggttctctgaccgtgctttttgaaacagatggggatgcggatacagcatgcttttccgacacacagatggtggcctttacaaataccaaagcctatcggtttgatttggtaaagggggagctgctggaacaggatgaggagcttgataaatttatcagcagcctgacgaacaacggtgaaaaaggggtttactggaccagcggcaattatagctttcttgtagcgatggataaagaaaatacactttatctggcctgtcaggacggtctgtatcagtgtacggcaggagaaagcccgaagcagcttctgcagggaaccctctgttccatgggagatccttccaatggaaaatatggaatgcttgtggaagacggtccggtattcctggttcttttctcctcagggttatcccgttttacctatgacgagacaatgcccgccactccggacaaagagctgaaggtttacagtcttaagaaggatcagacactgcagcaggctgtttccgcttatcagaaggctcaccaggatgtttttgtaaaatatgaagtgggtatgtcgggagaaaacgggcttacagcagaggatgctattaaggcattgaatacagagattatggcaggaaacgggccggatgtaattatgctggacggccttcccatagaatcctatcttgccaaaggaatgctggcagacttaagtgaaaacctgaaggcagcggaagaaaaagaggaattttttgataacattacccgggtatacgagcaggatgggaaaatatatgccatacctaccagattccggattcctcttctcatgggaaatgaggagtttgtgtcaaacatacaggatttgtcttccctgtcagccgttatggaagaaatgagaaagaaaaatccggaaggaagcattttatcggcatatacgccggaaattctgctgaaaatgctggcaatcgcgagtgaaccgacctggagtaaggaggatggaaatcttcaggaagagacggttaaggaattccttacacaggccaaaaaaatttatgataatgaaatgagcggtatttctgattcggaaaaagaagaattcctgaattccgtcagaggttcggatgacagttcgggtacggcggaggaaacagcgctggatatttcctggagtatcctgaatttcctgaccaagtcccaggcacagcttgccatcgggtcatcacagcaggtaagcctggactttaccaatgtaatttccgttcccagggttaagcctgaggtagtatataaaccgctctctcttcaggctgagaatgtatttcaggctgagtccatagtcggcgtgtccgctaaggctgcggagccggaaatggccagggaatttgtggaaatgcttttatcctataatgtgatgtctatgcagcaggaaccatatccggtgaacgcagccagctttgacagcctctttgatacggatatggaaggggatggcgcatttggttctatgggcatcagcaaggatgacggcagtgttacaaccctggatttatattggccaaatgaggaagagcagaagggactggaacagatggtgagaagccttaaaaccccctaccttcccggcagtcctatagaacaggcggttctggaagcgggtgtatccgtactggaaggaaatatgagtgtagatgaaggagtggcgcagataaaacagaagatacagttgtatctgtctgaataaatgaaaatgaaaaaaagaagaaagaaaagaaaatccgcatatctttttttcctgctgcccagcttcctgggagtgaccctgtttgtattggcgccctttgcagatgtggtcagacgatcctttgttacggcagtaaccggagaattcagaggctttgagaactataaaatggtctttgagacaagggccttccggatggcggcaggaaatacggcgcggtttattctggtatgcctgccgctgctgatagggctgggacttatcatcgcttattttttaagccgttttccccggatccgcttccttaaatccgcttttttgttccctatggccataccggcggctacggtagtgctcatctggaagcttgtatttgataaacagggatttcttaaccttgcgctgaccagcctttccgaaaggctggccggcatgggtcttgtggaagcagcaacggtttttcagacagactatatggggacatctgccgctttctgggtgttggttttcagctacatatggaaaaaccttggatatacagtagtgctgtggctgacaggcattctttccatatctgaggaagtccgggaagcggcacgggtggacggtgcgggagaatggaaatgctttataagaattattatgcctaacctgaagccggttttatataccataacagtgctctcctttttgaatacgtttaaggcattccgggaggcatatctggtagcgggctcctatccggatgaaagcatgtatctgcttcagcatttgtttaacaactggtttaccaagatggattttgacaaaatggcggcagcagcggtatgtatgggactgctgttatttgccgcaattatgctgctgcagaagctgtgggatgaaggagattgacgatgacgggatttttttatggacatcagggaaaaagaaggaagctgaaacgtgcagcgggccgtttcttcaggaaaatgcgggaaatggttatttacgcattgcttgtcctgatcgggctttttctctgttcccctgttttgctgctgttatccggttccataaccggagattatgaattgacccaggcgctgaaaccggccctcctggaaggaagcggatttatatcatgggacttcattccggagttcccaacgtttgcatcattccggaaactcttattttattctcctcagttttttatgcttttctggaactcaataaaaatggtgcttctgattctggcaggacagcttttggtttcggttccggcagcctgggcctttgcagtatataagtttccattccggaaaattttgtttacgctctatattgtactcatgctgatgccttttcaggtgaccatgctttcctcctacctggtactggacagactgcgtatgcttgacacccagggggcggtgatccttccggcgatattttccacgtttcccgtattccttatctaccgggggttccgaggtgttcatccgggtctgctggaggcggggagaatggatggcgcgggggagctgaggctgtttgtaatgataggactgcccctgggttcatcgggaattctgtccgcgttcgtcctgggatttttggaatattggaatatgattgaacagccgcttacctttctgaaaaacaaggccctctggccgctctccctgtatcttcctgaaatagggctgaaccaggccggatttgcttttgcggcatcagtggtcacgctgattcctgccctttttattttcctcctgggacaggattatctggagcagggaattgcgatgagcgggctgaaggaatagattttccggacagagatgaaagaggaacaggagaaatatcatggattttatacggaaaaagaaaaaaattcttattgcaggctgcatattctttggaattatgtttttatgcaccctgctttccaaaggaatatatggggccagccttccgcaggtggaaacggctgttccggaaaaaagagccattgggcatacggtggaagcggcgggaaatatcactgcgggcagagagcttgcggtagatgcggtgagcggactgaaagtaaatcaaatttatgttgatctcggagacagtgtttccgagaatacactgttgtttgatgtggatcaggaggatctcaaggagaagatcgccgagcaggagcttgccattaaaaaactggaaatgagcaatgaacaggcacggcagcaaaaggagctcgctgcacaaaagaatctgctgaaccagaaccgttccctggaggattatgcgctcgcagatacggaagaaaaccgtaaaatcgaacaggcaggggattccgtggcaaaggcggaggaaaagctgaatgatcatttaaacaaccagccgaaacagacctccgatgaggagagaaataataaaaaacaggaatatacggattgggaaagccgaatgaaggacctgcagaagcagcagattagtgcatcttctgaactggagtctgcaaaatctgcggaagaggcggcacagaaagctttggatgactatattgcggcccatggcagcagcggcaatacgggatccgggacagatgggggccaggcggcgcccgaagaaagtcagccgcaggagagcagtgctgctccggctgcggaaggggatgtaagcggtaatgatgccggaggcagtacagacaatgaaaactcagatgatacttcttccggaggaaatcaggacagcggacagtcccaggattccggtgacaataattccggaaataatggaaataacaatgacccggaaagggaaaaactggaggaagcgctgaaagcggccgtatccagaagagaaaacgcgcagaaaaggctgaaagaaatagaggacgagcttgcaaaaggcgatgtggatgcgaaaacaaagccggattatacaggggaagattctgcctgggataactggaagagcaccaaaaaaagcctggaggattctgtggacagcgccaaacaggatcaggagaacagtgtctgggataagctggatgctatgctggaagcaaagcgtaaggtggaggattccaatctcaatggggatcctgatctgacgatagaaatgaatcagatggagatcacctacaggcaagaaattctgaaaaagtatacacagctggaaaataacgggggacaggttttcggggaagataatggtattgtaactaaaattaaaatttcacccggagaaatcatacctcagggagcatcgattgtgctggcggatttggatgaaagtctgaaattccgtgttatccttaccaaagaagaaaaaaaatatgtggatatagaagatacggtaacgcttaagctgggaaacagcggaaaaacagtacaggcgcaggttgcgttcattgcggaaagcgaaagcatgccgggaagctatgaggctgttgtttaccttcccgaaggtgtcggaacagtagggcaaagcggaactcttgtggcgtcctcccagtcggaaagctatccgataaccataccggcaaaggcacttcacggtgaaaatgaacgatattatatttatgtgcttagaaagcagcaggggatcctgggagaggaactggcggtaagccgggtggatgtgaatgtgcgggataagaataataaatatgcttctattgaagaaggagccatagatgcggaaacggagattgtggtggattctacgaaggagctttcggaggggaaggtagtgaggtatgggaaaaaataagctattggtaaaaaaatcttttgacaaatccctttccccttgttattattagtgcaataaaagaaagagaggtatttttgtgttaattgcagtcaatgtgaggaagataagcaaatagcgatcaggcagaagcggagagatggtttcggctttccttctgtaagtctgccctgatggatttccgaacaggctgcgtttacagatactgatatcttatagacggcataatcctgcttgcgggattatgccctttttgttatatgccgtgcggacggcatatggcaaaaggctcccggacaggatttatatccgggttattatggagatccacagggtaagtctgaccctgtggatttttacgtttatggcttcctcagtaaggaacaatgaaaatgaaaattataaatctggagagaatagaataaatgaatgatatgaatgaaatgctggaatttcagcagataaaagaaatgttaaaggcacatgccatgacggaaaaggcaagagaacgcctggaagcactgaaacccttcctggatcagacaagagcggaggcggctgtacgtgaaaccacggagggaagacgagttctggatgcttttggaaatcctcccttttcagaaaccgagggcatacggaaaacaatacaggaggcacaggcgggcatcctgctcaatccggatcagctggaggaaatccgccaatttgcagtgatgtccatacgccttgtgagatatctgcaaagatgcagagagcttgcgccgggactggcaggctttgcggccggtcttcaggatctttcccatcttcaggatgaaattgaacgctgcattcgtgggggaagggtggatgattatgccagcaaaaccctgcgaagcatacggcagagaaaaagccaggcggaagagcagataagggcaaaactggattccatgctgcgcagctcgaaaagttatttttccgaaagctttgtctccaacagaaacggccattatacccttcctgttaaaaaagaatataaaaataaattccctggtacggtagtggatgcttcctctaccggggctaccttctttattgaaccggcagcggtttccaaactccgtgaggaaataaatcatctggaaacagaagaagaaaatgaagttaagattattctgtataccctgtccgcgctggtggaggataaccgggaggccattacaataaacctggaatatatggaagagctggattatgtatttgccaaaggaaagctgagcgccggcatggaggccagggaaccggcactgaataccaggcgttatataaaaatcagaaacgggaagcatccccttctgaaaagtgaaagtacggtacccttgaatatagaattcggaggggatacaaaaggcgttataattacggggcctaatacaggaggaaaaacagttgccctgaaaacgataggcctgctgtctgttatggcctgctgcggtctgcatattccttgtgaagatgcggatttggccatgaatgcggatgttttctgtgatatcggggacggacagagtatagctgaaaatctgtccactttttcctcccatataaagaatattatccgtattttggagaaggcggatgaggaaagcctgatattgctggatgaacttggttcaggaaccgatccggcggaaggtatgggcattgcggtcgccgtactggaagagctgcggagaaaaggctgcctgtttgtggtaaccacccattatccggaggtaaaggaatatggtgagagggcggaaggggttatcaatgccagaatggcttttgataaggaaagcctgaagccgctctatcgtctggagctgggcgaggcaggagaaagctgtgccttttatattgccagacggctgggaatgtcggaggaaacactgcagatggcatggaaagctgcttatggaaacggcggacaggaaaagaaagctctgcctgatataacggaagataaagaagagactcagaaagagagaaagcaaaaccccaaaaataaaaaaatatcccgtatccgttctaaggaagaggaacagaaagccggaaaacacaagcaggaagatattaaaagcagatttcaaatcggggacagcgttatggtgtatccccagcgtaagctgggaatagtctttgccccggcagatgacagaggtgatgtgggtgtccagattcagaaaagaaagcttctggtgaattacaaacgtctgcagctgaaggtggccgccagtcagatgtatcctgaggattatgatttttccattatttttgatacggtggagaacaggaaagcaaggcatcagatggaacgtaagtatgtaccggatatggaaattaaatatgagaaggaagcagatgaaaaataaaatgaaaccatgaatacttcaataatattttaagtgaaaagctgataattatttaaataattaagtaatacaaaagacggccatgaatacggccgtcttttgtattattaaactaaaccatactgtttcggctttacagcttttttaccggaagtgcaatacaccctccggtaagggtatccgcaccgaaattaacagacggcgccagctccggcgcatatgcatagccgaaacgttccggacggtaagtctggcttgcctggaatacggattcaatggcaatgcagtaatcctcttccttttcataaggaggggactggaaataaagataatcgcagggaggcagtgacagcagagtgcagccttccggtactgtaatatctatatcctcgggcagttccactccggcagcggtttctgtggtgccttccggatgaagggaagggggaagggtcataagagctgccgtttccagccggttgggaatgctgttgaaaaggccttcccattcacagctcatttcctcacagaatgaaaaataatcatgggctttttgggcatacatgacaagcagcttccgggccggtttatggatgactgtgacagtgcatatggattgggagctctctctttcctgaggggtgtttgactgattttccatttcttgtatctccttttgttttagataggagtagtaatgctgaatgggatattgaacaaaaagcggaatagggacctggccatggcggtaacgggacggagttgtgccgaaaagcttattaaaagcccgcgtataaccttcatggctttcaaagttcgtatccagagcgatatccagtatggtggaatccgttttaatcagagactctgcgctcgcggtcatctgtaccgcccggacatattcttccggtgttttatccataagctccttaaaaatacggcaggcatgtctccttgaatacccggcggcttcatataatgcatccatcgtaaaatccgcatccatacagtgatcccggatgtagttctgcattctggccgcaagttcaactttttcccattgcatgttgtgctccttcgtaaatcagaataacaggtaaagagagaagattcttgacctgaatggacaagattgtttttgcattacaattataccaaatgttccggggaatccatagagaaaatgttttatctacgcactatttggaaagatacctgaaggcggagaagaaaaatattccgaggaaaagctgtcgtgatggggtaaattatgttatataataattctattatatttttgcaactcagtattggttgaaaaattgttgatagtgctaatattaccgttcatagtttccctgtgctgtattatcgtttcctctgcccggtcttcccgctcccgttttttctgtacaggctgcagcgcggcaagaattcctgtaaaggtcgtataaatacgccggtccttaggttgcgtattttgcaaccttagtatcgctgcgtagttatccgagcgaaagcgtacctgcacaggaatcttgccgcgctgcagcctgtacagaaaaaacgggagcgggaagacccggcagaggaaacgataatacagcacaggaaaactgtgcaccttacggacagagggggataaaatgaaatggttttatgatgtaaggaaatcactgctgggaaggcttattctcagcattctgattatctggattccattcacggcatttgtgctgggaggtctggtgattgtaagcagacatcttacgaaggaaacgataaataaccagacggataaggtgaagtattattccgccattatcaatgcggacatcgaaagagtcatgcagtccatgtatcagctgtgcggaaataaggcaattgtggagtttacgggaaactggaagggacaggtggattatccttctttccttgcatatctggaagcctataataccattaaggaataccggaatataagcatgtacatagatgatgtatttgtttatctgccggattccaatgaggtgctcagcgccaactacagtattattccggcggacgatatttttcagaccatgaaaaaggactacttagagaatgaagtctcttttttccattttgatgatgcgctatattatatatcccagggcagcaattcggtcatggtgggaataaaggtttctcttttggatatccgatacaccctgcgcggatatgaaagtgaagagaattatgattatttgtttgtggattcggaaacaaaggaattattgggaagaccggaaaccgtatcagaaacaggaaggcaggtatatgagaagattgactgggagaagtcggaaacacaggtacagaaggtagagggcagcaaatatcttattgatcagattggaagcaaggcaaacaggtttttgattattgtttatatgaaccgggcggttgcatacaggacgatatatattctgtattggatatgggcggcaacttcagtggtccttctgctgatgcctgttttcctgactatagtgatacgccggatcataaaccggcctatggaaaagctgagccacgccatgaagctggtggaacgggaaaaatatgattataagctggagatggatgaatccaaggaattcaactatgttttcgccagatacaaccaaatgacggaaaaggttaaaaatctgatacaggaggtcctggaaaaacagctgcaggtagaacaggcaaaatataaagagctccaaatgcagataaacccgcactttttgtttaacagcctttatatgggatatcatatggcaaagtccgatgactgcgaagccgtgggcgatctgtgtatgtatctgggagactatttcagcgtgctgacctttgcatccaacgagtttatttcgatagacaatgagctgaaatttataaatacatatttaaaactaaatcaaatgcgttttggtcaaaagctgaattatcggattcatgcggaagaaagcctgggggattatacaattcctcctctgcttcttcagccgcttatagaaaattccattatgcatgggatggagaagtgtacgcatccctgtctgattgagattacaattcgtgaaaacggagacagaattgatttttccgtggaagataattccggtgtgataacacaggaaacgattgataaaatcagacaaattatatcgcttgataaaatgccggatacctattttggattatggaatatacagaacaggctgaccaggaacggggactgtaaggaaggactgtatctggaaaaatcagatagcaaaagcacctctgacagcaccatttccacagaatactctattttccggatatctttttccatcgcaaagaggaaggagcattatgtatagtttactgattgtggatgatgaagaaattattttaaacggaatcaaagatgcggtgtcttcctccgctctgcccttgaagtctgtgaggacggcatcttctgcaaaagatgcgctgaaaatgctcatgaaggatccctgcgatattattgtatcggatatccgtatgcctgatatggacggactggaaatggcggaacaggcgaagcggatatggccggagacaaggatcatttttctcaccggataccaggactttgaatacgtaagaaaggcgctcaggcttaacagtgatgattacctcttaaagccggtgccggatgaaaaattaacagaagtgatcggcaatgtgatttccaagctggacagcctgtggatggaacgttttgacttaagatacagaaaagcagcggaaacagaaaagacatccataaatccgggaaaagcagtatatttcctgtttattgcctatgaagcggatcaggccagaatgagcgggtcagagcttcataaaagcctgtgcggaatgctggaaaggttattcgggcattactgcagtgcacttttgtttgaaaagggggagaataacacggttatatggcttcagcctgtcatagaagaggaatattgggataaggtatgtttgaaaacgctggaagagctgcagagttttttccttgaacacatggatgtcaggatgtcgatcggattgtctcagaaggcaaagccgggggattcggaacagttaacaagcaaaatgaaagagaagtgcctgggaaaggataatttcggatgtctgtttattttggacgctgaagaagaaaaagaaaacagcagtgaaaattatgcggttaaagccgttcagtcttatatccgcaataatcccgaaaaggatttgtctttaggcgcgctttccgacagattcagaattaatccctcctatctgtccagagtgttccatcaggagaccggaattcccctttcggaatttatagtccggatcaggctggttcttgcgaaaaagcttttagcggaaacagatatgaaaatttatgagatagcccagaaaacagggtttgaaacacctgggtattttaccaaagtatttaataaagcggaaaggatatctccgagaaatttccggctgaatgtaagtaaagataaggcagaaaagtaaaatcattaccatttcccctgtaaaattgttgtgataccataataacaacaagtgcagcggccgatgcacaggggcgtaaaggcgcccgtatgaaagagatactgtcttatgtggtaaatcaatttggagggtgaaatagtgaaaaagagaaagattacctttattctgctgttatgtatgattatggcatctctggctggctgcggtaaatcggcagaggaagagaatgtgaaggtggaaggtccaagcagtgatgcggataaaatgaaaaaatatgacccggagataacccttacctttgccaaggccgaggtcgtgacgaattatccggaagggcagaatgcacagaataatgccatgtaccagatgtgggaagatgtcatgggaattaaagtggaaaactctattctttgtgcttccaacgccatgacggagaaattccagcttgcggtagcttcggatgagattccggatttcggcattgtggatgcaaccactctggcatccttaatcaagaatgatatggttacggatatgaccgatatttataaggaatgggctacggataatctgaaggaagtggcaggccagcaggacaatgccctttttgccccgaccgtaaaggacggaagatatatggcaataccggtagccaatacggtgggagacagctatcctattctctggatgcgtaaggactggctggatgcattagggctggaagaaccgaaaaccatggaacaggtatttgacattgcggaaaaattcgcactctccgatccggacggaaacggaaaggatgatacctatggtttatatctggacaaagacttaaatggactggatttcatcatggcggcttatgaggtttacagcaaggatgaatattgggtaaagcaggaggatggaagctttatagcgggctgtaccgattctgatgcaaagaaaccgttggaagccatggcgaagctttatgaagcgggagccattgatcatgaatttgccgtgaaggaacagagcaaagaagaagaattaattgcttcagggcaaatcggaatctatataggttacttttacagccctttgggagtgatgaaggacagtgtggcgaatacaggggccgactgggttgctgttcccatgccggcagcggaaggctattcggattataaaccgggtgtcaacctgaacgtatacggatatatttatgcgaagaaagggatcagcaatcccgaggcaattgttgtaatgctgaaccatctttgcgacggatatgccgcaccctggcttgctgacggaacaagcgaattttatgagaggtataatgaactggcctctgatccggaaatcagccaggcgggtgccaacaatctgatgcctttccagatggctggaaatatcaactggggagaaaagtttacggaagccattgcggccggtgaagagcatgtggacgggaaggatgcggatttccagaatgtaatcagtacggagctgcctgcggaactctcctgggcatggaaaaaggtatatctggaaggctatctggtgatggatctggataatgtgcggtacagtgattataccggagcacccaccgagacaatgagcaaaacacagtcacttctgaaaacacagaagcttaccgattatatatccattattatgggagatcagcccgtggattactttgatacctttgcggaaacgtttaacaatataggcggagcaaaaatcggagaagaaatcaaggaagcactgcagtaatttcttccaaaatggcggtggtgtacaggaaacactgccgccgtttttgtaaggttttcaattaattatcgaggtgacgcagatgaataagatggaaagactcagagttaactggaaaaagaactggcagcttcatttgatgctttttccggggatactgctgattttgttatttaagtatgtaccgctcagcggcatactgattgcatttaaggatttcattcccagaaaagggatttttggttcgccctgggtcggtatggagaattttgagtacatgttttcccttccggataccatgcgggttttatggaatacactgaaaatagccgtattgaaaatagcgattaatttccccattccgataataattgccatccttttgaatgaagtaaaaagcagaaaatttaagaaaagcgtccagacaattatctatcttccttactttatttcctgggttattttatcgggaatgatactggatattttttctctggacggtgtggttaaccagttattaggaaatttcggagtgaatcccatattttttatgggggataagaaaccgtttttagggcttcttatcggaacggatgtctggaaaaattttggctacggtacggtggtatatctggccgccattacgggggtggatgaatctctctatgagtccgctaaaatagacggtgcaagcaggtggaaacagattctgtatataacccttcccagtattgcccccattgtaatgctgatgatgattctgaacctgggaaatatcctgaatgctggatttgaacaggtatttacattgtacagtccccgtgtttatgaaactgccgatatcattgatacctttgtataccggatttcgctggtggaggccaattacagccttggtaccgcggtcggtctgctgaaatcggttgtcagctttctgttaattgtcagcagctataagctggcgaataaatacagcgactacacaatcttttagggaggaaggggcaagatgaataaagcaataaaaaaatacacgttccgtgttattaacggcattttcctggcggcgcttgcggctctgtgtctgcttccgatcatacatatattagcggtatccttcagcaaccaggcagcggtatcggcgaatcaggttggtcttattcccaggggatttacttttgcatcctataaaatggtggctaaaagaaatgccttctggcaggcctttggaatttctgtggaacgagttataataggagtaatcattaatacggtaatcacagtattgatggcctatccgctctcgaagaaggagagcgaattcccggcaaggaagatttatgtatggctgctgatttttgtcatgatctttgacggcggactcgtgcctaattatatattgataaaggatcttaacttatttgataccatatgggcgctggtattgccgactgctgttcctatttataatattatactgaccatgaattttatgaaacagctgccgggaacgattgaagaagcggcaatggttgacggggctacttattttcagcggtttattaagctgatcattcctttgtcgaagccggtcattgccacagtaaccctgttcagcttcctgaatcattggaattcctggtttgacggcaagatctataataatcagactacgaattatccgctgcagacctatttgcagaatcttatttcaaactcagatatgaccaatgccgcggaagcgattgaaaacgcattatcaaatgtaaaaacactgcaggcggcccagcttgcgctcactcttctgcctattcttttgatataccccttcctgcagaaatattttgtaaaaggcattactgtaggggcggtaaagggttaagcggcagcgcagaggcagcaggggaatggcagcaggaaaaacaggtttagggaggttaacggaatggctgattttttggtttcagattttttggatttgttatatgaggatttaagaaaagattttatgtctcctttacaggtggggaaggaacggtgggaaagctataaggcaggaaggctttcagaaatcagacaattattgagaattgatctgctggaaaacaaatatgaagaagctctggattatactcttttggaaagccataaagaagacggaatcaccatagaaaaatataaggtggagcggataaaaaaactgtctctctgcgtttatgtactccgtcctgatacaggaaacggaaaggctttattatatctcaacgggcatgatccgagaggggcaaagggagtattcggggcagaaggccgggtgaaagcggatggtaattcagaaaaagcgctttccatggaaatggcatccatgggctatctggtgttggtaccggagctgtttggctttggggaagcgaagagaaaggatgcgccggaagggacggatgcctgcgccagctgttccatgctggcaccgcgccttttgaattcaggtatgaacctggtgggtatccgcgtgtttgaagccatgaaaacattggattttgcggagaaagcatttgctatccattcctttggcgcctatggaatatcgggcggagggcaggtgtgcaattatgcgggagttctggatgacaggattgaagccgttatgattgccggatatccgaatctgtataagtacagtatactggcaatggatcattgtatttgcaactatgttcccggacagctggaggcgggagagagccatgagattacctcgctggcggcccccaaaaaactgcttaccattaacggcagaaaggatcctatttttcctcttcagggaagcgtggaagcctttcagcttttggaagccgtatatgaaatgctgggtgtgccggagcgttacagccatgtgctgttcgatggcggacatgaaaattctgtcccggatgtatgcgggtggctgagggataattactgacaggaggaaaagggatggaaaagcggctgaaagaggtattaaacagggaagaaggaaactatatccttccttttttctggcagcatggggaaggcggcggaaggctgagagagatgatgggcgctgtgtattcttccgggataagggcggtttgtgtggaatcaaggccgcatcccgattttgccggtccgggctggtggagagatatggatattattatggacgaggcgcggaaaaggaatatgcgtgtctgggttctggatgatgcccatttcccttccggatactgcaacggacttgttgaggaacagtctgtctatgcaaaacgttacctggatcattatacaatcgatgcgtcaggtccccggacaggaacctctttttttctgtccattgatgagggagaagaattagtcggtgttgtcgccgcccggagaaggggcagaacggcgggagaagttcaggatcctgtggatatcacgaatcaagtaaggggaaaggtattatattgggatattccggagggctattggaatattatcgtcataaaaagtacattttccggcagtggaagaaaaaaatatatcaataccattgatgcatcctccgtccgtttctttctggatgtggtttatgaatcccatctggagcattatggagaggacttcggcaatacttttgcaggctttttctctgatgaacctgagctggggaactgtctgggagaatatgggcataacgcggcaatcggccagcctgatatgaagctgccctggggagaggagctctttgggatggtgaaaagcttctggggaagcggatttgcggtacggctggcagcgttatggaaccaaatgggggatctcaccccacagtccagatatgagtatatgaacatggtgaccgatttgtacggcgggaatttctgcggtcaaatcggagaatggtgccgggagcatggtgtggaatatatcggccatgtgattgaggataacggaacccatgcaaggcttggcctggggacagggcattattttaaggcactgtgggggcagcatatgtccggtatcgatgtggttttgcagcagatacgtccgggttatgataagatggatttttatcatatcggagggaaggggacatataacgggactttttttcatcacggactggctaaaatgggggcttctctcggacatctggatccgaagaaaaagggaagaaccatgtgtgaggtctatggtgcttatggatggagcgaagggctgaagctgatgaaatggctgacggatcatatgcttgtgcggggagtgaactggtttgtgccgcatgcatttactgccggcccgttcccggatcctgactgcccgccccatttttacggatggggaaataatccgcagtttccctggttttcctgcctgtgccattatatgaaccggatgagccatcttttaaacggcggaacgcatattgcggaaatcgcccttctttatacggcggaaacggaatggatgggttcctgtcagccttttgaggagatcggcatgcttttggcggaaaaccagatcgactacgaagtagtgccaatcggtattctggaaacctgcgaggctgcggatgggaaaatgagggcagggaatgaggaattcagcgttctcattgttcctgattgtgaatggataccggaagagctggagcagtggattgcatatgctgtgagtaacgggctgtcggtattgtttgcgggacgccggcccggtgtgatgaagagcgggtggcgccaggcggaaagcttcagcggctggaaagagatgcacaaagatgtgcgggggatggatattgctgcagaacagccggaagaagaggatgggaacctcaattatggatacggagataatacggaaaatctgatatgtattgaaggagatggggaaaaactgctggaaaatctggagcgctttgtggatcgagatatacgttgtgacaggaaggttcccggactcagatattatcattacaggcaggacggcggcgaattttatatgttcttcaatgaagatcccgtgatgcaggtacatagctgggtttctgtacgagagagcggagaatgtcaggcctgttggtataatgcctttgataatgttctggaacctgcagtgagaaatgaaaaaggggaagtggagctgaagctggcgccgggtcaggccgctatgctttatctgggaacggatatggatttgccgcagccacaggtttacaagattgggaagagtcttgtgttggaggaagactggcggatttccttccggagatatgatgaaaaagattttggcagcagtaaaaaggccggaaaactctataatattacagccgccgaagaaacagaagatttttccggtacgctgcgttatgaaatagatcttgaatggaatccggatacagacggtgagctgctggagattgattttggaacagtatatgaaacactggaagtctggctgaatgatgagaaggcttcggtcaggattgcgccgccctattgctgtaccctgcataatttacggaaaggcacgaaccgtctgaccgtatttgttgccaataccctcgttcataaatacagggattccttttcggccactatgccgattgaaggaagcggtctgctggggcctgtaacggcgcagggatactggaagtaaaatacccgatcttttttacagataagggaatcatagtccgataggattcccttatctgcggaattttgacacatattttgcaaatatgtccgttccgttgtcagttacgtttaaccagcccctgctccgtcaattcataggtagtatcaaccacctcttccaggtactttctgtcatgggaaatgctgattatcgcacccgggtactcttttagtacctgtcggatgacagggccggaaagcggggaaaagttccgtgttggttcgtccagaatgaggacattgcagccgtccaggctcattttgagaaaaaggagcttggccttctggccgccggaaagctcccggatggcatgtgacatttcatctgcggtatagcgcatgcttcccaggtaggtccggatagtggttctttcctccttatcgcccagagaggaaagaaagtcgacagggttctgctcccgattcaacagttcttcatagtcctggggcatataggccgcctttaaatcagggcgggcaagaagctcctctgcgatttgtttcagcaatgttgtttttccggcgccattgcgtcctacaatacctattttttccggtccggttatacgaaggaaaataggggaggccagaaggcgtccttcaatcataagccgttccttctggcagtcgagaactattttgccgtttggaatccgggtttccggagttatttttacaaaaatcgctttttctgcatcaggcatttccgtcatatcttctttttcccgttcaaaccggtgttcctgtgcttttactgctttcatttttttcttaagcagcttggctgtaaagggatcctggcgtgaaatattattctgctgtgattctaccttctgctcgatctgtcggaaacgttccatttttttccggtattccctgcgttcattttgggcctgctgctcctggcggagaaaggaggtctcccgattcgagatatattcccggtagggcatcctcacgatcgtatgtctcggctgtgttttccttataatctgttccagatggataatcacattggcggtatgctcaatgagggtttcatcatgagagacatagaggacaggcttaccgcaggtattgataaactgctccagccattccagggtttcgatgtcaatgtcattggaaggttcatccagcagataaatatccggccggcacatctgcaggacagcgatctgcagcttcactttttcacctcccgaaagtgtgccgcacagctggtcggagtaaaaaatatccctgggaagccgaagccgggcggcgatagcggccagttctcccgggttcctgtctgaaaaagcaggaatggacgtgcaataggtatatatggtctgctctttgtattccggagggaactcctgaggaagatatcccatgagtgtaccctgggtaaggatatctcctgtgtattccacgtagctgtcaaccagccgggaatcataaatcagcttcagcagtgtggattttccattgccctcctcactgataatgacggccttatcacctgaattgagggaaaaagtaaaatgatccagaagcggtctgagatcctttttgtgtgttatggaaagattttttatttgcagcataatgcatcatctccttactcaaacggagcctttgcctgcgacggaaaatggaatataaaaaatccactttccgtttattgccggaagtggattaacgcataaataccataaaaacacgccggaaagcaaaagctttctgcagcgcatgtataatcaatgataaatgctcacaatccgaattttggcaataaacatacagcaggtattatcccgaaacaggaaatacccaaaggcttataaaagtttattgaacagtcaaagccaggctttggccgttaaagttccaaattcagattatttccgcatcttttcacccttttcttgttaaaattggaatcagcagagccgattctccattactatagcatggggaatttcgtttgtccagcatatcttttttcaggaacagttcgttccgcttaattgcgttttattatttttgatgtattaaatgtttttgtataattaaggaggacagctgtctcttcagaaaatacgatatttcctgtaaagcttacataaaaaaccaggaggttggaaccaaaaacaggtaaggagccgtaaatatggcgagagaaagcgccagttttttacggaggatccgatccggaactgcttttctcagacagaaatgataattgaagagaaaaatacagctgccgctgatgaggatacagaggattgtccagaggaatgccgcgggggtggagagcggattataggtaacggcattggtcagattattgtaccaccattctgtcaggggagatcggtagtccagaaaggaatcgatgatattcaccaggaacatgaaaaaggttccgatgaaatcggaaataaatccgaaaccccatattttcaagatagagcgtttgacgatttcttttcgtccggagatcttcaggcagtgcatggtgataagaagtacggcaagatcaatcaaaaagttggcagggagtattacaatccaggtagaaggaatgatccacagcagccaaagcggaaaaatcatattgtacaggatgatattttttgaggatttttcggaataaactttataaatattatgtaaattacttaaatatcctttcattattaatctccttatcgatttaggctaaatcagcagttatcaaaacagggcggacacagcatccagtattcctgtaaaaagcagtgcgggcagcatatttcccacccggaatttcttcccgaaggcaagattgattcctacgcagaagataaggacatttcccacaaaggaaaggtcggatatgatctgggcggtaaggacaggttccaggaaacgggcaaagagggtgatgctgccctgccataatcctacggggagagcggaaaagacggctccttttccataggaggaggcgaatacgaggacgataataccatccaggacagcttttgcggcaagcatggaatagtctccccgcataccgtcttccagggcacccacgatagccattgctccgacacagatgaccagggatgcggatacaaagccttccacaaactggctgtcatttttcccgcccgctttttcccggagccactctccgaaatggtccatccatttttctatttgtatccattcccccagaagggaaccgagtaccagggaagcgatcagcagcatggtgcctgatgtttccagaacgccgttttctatgcggtacattcccttcagcgcgccggatataccgatgaagatggtgcagacacctaaagcctgcatgagtatttgctgataccgctctttaagaccgcctttcaggagcatgccggcgcctccgcccagaatgacagcggcaacattgataatggttccgattcctctcataaaattcccctcgtgccgggcagttaatactgccggcttttaattctgcctttgaatgattagtgttttaaactttaaatattactttaacataagagaacgttttgctccacaaaaaaataaatggaacacgtctgacacagcagtctttttacaggtggtgctgcattcagctcttgcagcgaagcagacactatttaattattaaggtaaaaaatataaaaaacaccacacacctcaataatccgggtgtgcggtgtttttatcattctatgcttttatctgcccatctcaaaaagttattcgaaggtgatggctaccttaaagtccccatattttcctgtggcataatcaaacgcggtttcccattcttcaagggaaaaggttttggacaccacaccctctgttttcaggttcccattgctgatgttttcaatgacaaagggataacagtaagggctgagatgggaacccaggagatccaattcctttcgatctccgataatggaccagtctacggtagtcggttccccgaaaacgctgaattccacgaatcttcccagcttacggatcattttcaggccctgtaccacactggaaggatgtccggttgcttctatatatatgtcgcagccgtagccgtcggtcatgtccagtattctctgtaccacatcctccccgccgggattgatggttatgtcggccccgaattcctttgccttttccagccggttgtcggccatgtccagggagattaatttagatggatttttcatccgggcatacgtgatcatgcccagtcccagcgtacccgctccggaaatgaccaccacgtcttcatttcctatctgcgcccggtctacggcgtgcttggagcagccatagggttcaatcagcagagcctgatcaagaggcatatcctcaggaaccctggatattacagaggttttaggatatctcacatattccgccattccgccgttgttggtattctggaatccgaaaatggaatgaggctggcacatccagtatcttccgcttttgcagaaccggcattctccgcaggggacgatctggtctgccgtaatccggtctcccagggagaagcctttcacctgagaacccattttaacgatgcgccctacaaattcatgacccggtataaagggaggctttacccagggagcttctttttcatctccccagaacatggccgctccgtgctggcattttaaatcccctgcacagatgccgcagccttctgttttgattatgatgtcgtcctccccgcattcgggaacaggataggcggtttccagccgatagtcaccgttgccataggctaccagcgctttcatggttttaggtaaatcattcattgaggcattctcctttttttgaaaacaagtactgtcagtcgttaaggataatatctacggaatcgctgaaggttttcagtgactgatcaatatcctgattatccagcatgatagcctggatacatgttctgaattctgcaatgacgggtgtcaggttggcgatgcgatagctgtcatcaccatactgaagggcatcataagcgattttgtagttgtcactttctttccagagattctgaatggcgtcggactgtgccattgttttggtgaaaggaagataaccggagccgataacaaaggcaaggccgcccttttcgtcttcaataaaccatttcatgaatttccaggctgcatcctgttctttgctggcagccaggataccgaagccgtttccgccggtaggcatggattcgattttgccctttaccaggggagctaccacatattcaaaggaatcaccgatggtttcccgtctggaggtgatggcgcctgaagaattgatggtcatggctgccatgccggaggtaaacatctggttatcctgatcgttggcgggatcgttgtaatacagggcgccggaatcctgcaaatccttcatgaagctgaaagcttctttcgcggttccgtcctccagacatcccagcccggtctgatcttcgttgaagaacttgccgcctgcctgctggatcagggcgaagaactcccactggtcaaaaggaacagacagcccgtagcgtttggtttcgccgttttccacgatggtgcatttgttggcaacctccttcagttcttcccaggtggtggggatttcacagcccatctcgtccaggactgttttgttgatgtgaaggatctgggcggaacggccgaaaggaataacaacaagctttccttcataataagcgtcatttacaaaggcgtcaacaaaatctttatcatccattccgtccttctgcatgtggggaagcagatcggcaaacgcgccgtttacggcaagcctgcccacattgtcctgggctacctggaggatgtcgggggcattgcccgcaaaaatagcctgttccgctttggcggcggcttccgcgtagcttccctggaaagtggcgaccacttccacttcattctgggagctgttgaaatccgaaaccatctggttgattaaatccccgtttgtaccggacatgcagtgccagaattgtacggttttcttttctcccgaagcctgtgtaccggcggcgctttcagccgcttccggtgtttcggctgcctgggcggaatccgttgccgccggagcgggcgcggaattttccgtggaagcgggagccttgccgcagcctgcgagagcggcagccagaatggaaacccccattaacatacttaaaactttctttttcataaccatatcccctttcgtattgtttggtttacttaatccctgaataggcaaaggatttcataatttgtttggaagcgaacagatataccagcagtacgggcagaaccaggatggcgtttcctgccatgacgatctgccagttggccataccttccatttccttcagctgtgcgatagccaccggaagcgtccggtacatatccgcattggtcatgacgagcggccagaaatattcgttccactgtccgacgaagctgaaaagtataatggaagcgagtgccggcttggacatgggcatcattatctgcaatatcaccctccattccgatgcgccgtccagctttgccgcttctatcaattcattctctacctgcataaaatactgtctcagtaagaagatagcgaatgcatttgttataaatggtaatatctgaggaagcagggagtttatcagcccccacttggacatcatcagatatacgggtaaaaatgtgatctgtgtgggcatcatcagcgcgatcaggatgctgccgaacatgatttttttccccttaaattcatatttcgcaaaggcataggccgccggaaccaccaccagcatctgcagcaaaatgacgctgagcaccacgatgatggaatttttcagataaatccacatgcctccggccgggccggaatgccaggcatccagataattatgaaattgaaggactgccggaaagaatgtgggcgtaacccggtttacttcatctatcgtctgtaaggaggtggaaatcatccagaaaaaaggccacccgaagataaataaaagaaacaatttcatgattacgccgccggttttaatcagtctttttttgagccgcataataatcctccctttttgctctctgtaacctattggtaatgtaccttcctggaaaagccccagaagtaaatgactgtcagtatgcttactatgatgagcagaatcaccccgatcgccgcactgtagccgatccgcagattcagaagagcctcggtataaatgctgtaaaccagcgtggtagtggcattgttggggcctccctgggtcaggatacgcaccgtatcaaaaaccttgaaggagctgatcgtacggattatcaaggtgaagaacagctggggtgaaatcatgggaagggtgatcttgaaaaagataaccactttattggcatgatccagctttgcggcttcatagagggatgcgggcacgctctgaagggccgccataaaaatcagggtatcatatcccacggccttccataccgataccagtatgacggaaggcattgcggtggaggagcccgacagccaggaggatgtgggcagccccagctttcttaacaggaagttaaacagtccgaaattcggttccatcatccagagccatatcagagcgatggatacaatggataccacatggggacagaagacagcggcctgtaccagccggttcagctttgaacttttttcgctgagccataccgcaagcagcagggcgattgccgtaataatcagaaccacggctatagtgtaaaccacggtgttgtttaaggatttgtgaaaatccggcctgctcagtacctttctgtagttatccagtcctataaatctgctttcggaaggattgagcatattggtgttcataaggctgagctgtatcagcttaattataggataaatggtaaaaagcaggattccggccagagccggagcggtcatgatgtatggccttattttggcggcaaatttcttgtacttcatactaacatcccctccctggtgtttaaaacctcgtttccctgtaccaccttgacacccctgtctctcagctgatcaatgaacggggcgggtgtacgccagtcagtcacaatgccgtccagatcggatacggaagcgatgagccccagagaatcgtctccgaatttgctgtaatccagcgcgatatagtgttccttgcaggatgccatcatgagccgtttcatcctggcctcctgcagatccggtgtggtgaagccatgctccagggtaaggtggttcccgctgataaagcctttgtcaaaaaacagggtcttcatcatttcttccgcataagcccccacgcaggataaaatccggtgacggaagttaccgccgatcacgatgacggaaatatcttccgcttccgaaagctccatggcgatattgatggcattggtacccactagtattttccgcttggagccgctgcgtatcacccgggctagctgtgttgtggtggtgccgcagtcgagaaaaaccgcatccccgtcactgatacagtcgtaagccgcataagcgatggaaagcttttctgccgtatgcttccattctttttccttgtgggaaaattcattcagggatccgtaagcgcttatggcgcctccccatgttctttttaccaggccttcctgttccatggctgccagaagcttcctgacggatacatcggaaattttgaaggcttcgcttagttgggatacggtaacggaagactgggtatcaagtatcttgatgatgaattctttcttttcctgcgttgtcattttaaaatctcccaaaacgaaacaattaatgtgaaatttaattacgaatttcgtaaatatttgttttgattctagcatcaatgagttttgatgtcaattatttacaaatattatattaatttcgtaaataattcatataaattgacttcaaaaactgttaataatttcaattgacttactaaaaaagaccttttatactacatttattgttttgaatataaaaaaaaagaaatcataaagtttcgaaatgaaatcaaatcttataaaaggtttcgttttaaattgcttttgaaaaggagaaagaagatgagtccatatgcaacaaaggtgcttgcctttgacctggacggaaccctgacacagcataagtctcccctgtcaccggaatacagagagctcctttgccggttgggagaaaaatatacgctgctgatggtgggagccggttcctgtgtccggatatttaaacaaatgaggcgttttcctattgaaatcatcggcaattacgggatgcagtatgcggttgtaaaagaggaggcttcccatccccggattgtgttggagagagataaccgggcggaggtggacaaggcgcttgctgtcagaagggcggatgaactccgcagagagctgggatacacctcttatatgggagatacgatagagattcatgaaagcggcatgctcactttccccatattggggacggcagcgcctatccaggacaagctttcctatgatccggatcgcagcaagagaagagcggtttatgaccgggtggtggataagttccctgaatataaggtgtatgtgggaggttcctcatcttttgacatcgttccccacccttatgccaagctgtatgcgctggatttgttctgcagggagagggggctttctcatgaagaaatatggtatttcggggatgattacgggattggaggcaatgatgaggatgtatttttatcggatgtcccttttcagtgcgtcgatgattaccgcaccattccgaaatacttaaaacagtttttataaaatgggaggacagtattatgatatggaatcagtcggaaacaaatatctgggtggcggggcacagggggaatcccgcggaatgtccggaaaacacgatggcttcttttcggaatgccatggaggcaggcctggacatgatcgaactggatatacagatgtcgaaggacggcgagctggttatcatgcataacctcaccgtggatcagacaacggacggctccgggccaatccgggaaatgactcttaaggaaatccgttctctggatgccggaagtaaattcagcggagaatatcagggggaaagggttcctctttttgaggaattccttgaacttacaaggaagtacccggatatgacatatgattttgaattgaaggaatatccgacagacgggaatgagagccgggcatacgaaaccgcagatcgggtgataagcctgattgaagaatacggtttaggggataaatgtgtactgaatgccttcagcgccgtgctgctgcagtatattcatgataaatatgaaggccgttataagctgcatgggtattatcccaaatcccttctgggtacatggaaagacagggatccttatgatattttatattgcgcctgtgtctgcgaggatttcaccagggaaaatttcgaccgattgaaagtgaagggaatagatacctgggcgggaacccggtttaaaaacagggagatggcagagctggcccgcagctgcggcgttactttgattacctgtgacaatccgcgggaggtcatggggatcctgcgggagatgggactgcataaatagtgatataaaacagaacaatttatctggcagccggatagaaaacgcaggaacagggagggcctgcataatctttccggttgcacagatcctttttttgatctataattaaaatacttttaaaaagtattaaaaactcttaaaagggagggcgacttatggcaagtacgattactgtcagggatatgaaccaggaaattgtaagaagctgtatgaaagggctcggcccggtgagcaagagcagccttgcccgtaaaaccggactgagttttccaacggtgagcaaaaccgtagatttgttatgtgaatcaggagaagtggaggtggcggggacggaaggttccagcggcggaagatgtgcggcgctctaccggctcaatcccatgtatgcgctgtaccttcttctggccgtggaaaatgacagtgtgcactggaagctgaaggatctggagggaaacagcctgacttcaggaagtacggaaggagacggggaggtgctggcggttctggaaaaaaaggtggagagtatccggcagctgtatcccagcatgaaagggattgttatcggcgcggcaggcatggtttccggcgggaaaattcttctgtcgggaggggaatgccagctggtgggaatcgatcttcaggcgtatttttccaaccggttcggccttccggtacgggtgatcaatgatatgaatgcggtagctgccggacgctggagctcggacgggcagaaggacaactgctgtgtctgcgtttacctcggcaagaacggcatgggcgccggcatagtcattaatggaaacgtttggcagggagcgagtgatttcgcaggggagctgagctttcttccggatatgccgggaaaactccgtccccaggacaaagactttgccccttcccgcatgctggacgcttaccgtaaaatcatccagatatatgcctccatattgaatccccagcgtatcatcctgtaccgcaatcctttcctggagggcgttctggaagagctttaccaggaatgcgaaaaaatcatccctgagcactccatgcctttgttggtgatatccgatgattatgaaaaggattatgaaaagggacttatggtaatcgccggttccttataaaaagaaagggtaataatttatgaaaaaacatatcatattcgatgtggacggaactcttctggattcggaggaagcggttctcctgtctttccaggaaaccctttaccgtaaaacagggaagaaaacggatatcagggatttgaaatatgccctggggattcccagtgaagcggccttaaggcagtatggctttcccgaggaagaaataccggaaatcgtggatttctggggggaccttacccctgattaccgtaaatttatcaaggtttttcccggaatcaggcagcttctggaaaagctcaaagaaaagggggccagactggggatagtaacctccagaaatgcggaagaatacagacgggacttccttccctttggcctggagagctattttgatacggttatctgtgcggatgatacccttatacacaagccttacggcgaaccggtgaaggaatatctgcgcagggaaaatgcccgtgcagaggatgcggtttttatcggcgacaccgtttatgatatggactgcgcggcggacgcgggagtggacggtgcgctggctctctggggctgtgcctcgcccgcccatatcagggcggactattacctgtcctgtcctgaggatgtatttacttcctttatactggagcaagatcccctgaaggagcataaatggctgaaatgggcgatggagctgcagtttatagcccaggcgggccttacttattcccgggatcgttttgaccgggagcgtttcctcagaatacaggaaattgctgcggaaatagtgagctgcaatactcctatggactttgaacagattgatggactgtttgccggggaaatgggttatcagactcccaagctggacagccgggcggcgattatccgggacggaaaaatcctgctggttcaggaaatggatggcacgtgggccatgccgggaggctgggtggacatggatcagacaataaaggagaataccgtgaaggaggcgggggaagaggccggaatgcttgttgctccggtgcggctggtggcagttcaggatcgaaacaggcataataagccaccctatgcatataatatctgcaaggtatttattttatgtgaaccggtggaaggagaatttgaaaaaaatatagaaacgctggggagggaatggtttaccctggaagaactccctgttctgtcggaagataaaaccacaaaggaacagatagccatgtgttttgaagcagccgctgacaaagattggaaggttttgttcgattgatatttattggtaataaatggtacaaacatatatgtttttaagaataaacacaataaaataagctcatatttacgggcaattggctttgacaagacaatacacctatggtaaacttatatgataaaaaagtgggtaattatgcctaatcaggattacggtagaggtggcaccttggataaatatgagtacaaaatacgggcagaggaaatcaaaacactgatttcccagaagaaatatgtggatgcggcaaaggtagcggatacaattgactggaccagggtaaaaagcgtgatgatgctttgtaccgtcagtgatttgtataaggtgaacagaagatttgaggatgccaagctgctgctggaaatggcgaatgagcgccatccggcagggagaatgatcatttattccctgtgtgacctgtcaatcaagatgggggaagtcgtacaggcagtggaatattataaggatttcacgcagatagctcccaatgacagcggcagatatgtccttcagtacaagctgtatgaggcccaggatgtggggcttgaggaacggatagccgtgctggaggaactgaaaaaaagggattacagggaaaaatgggcgtatgaactggcctatttgtaccatcgtgtgggacttgccaccaaatgtgtggaggaatgcgacgaactgatcctctggtttggggaaggcaaatatgtcatgaaggccatggagctgaaaatgctgcatcagcctttatctcctgcacaacagcagaaatatgaagcatatatgatgcgcaagcagggccttcgggtgccggagcctgaagataaacaggacaagaattcggaaggacggaaaaaggctgaagaggatgatatccatgtaaagcctatggatgtcgggaagtataataccataaacctgcagaaggaactggctaaaagtatggaggaactgatgcttaacggccgtcagcctgccggggatcaggtatctcttcaggagtatcgggatcagatggccgggcaggagaattcctatgccgaccagtcctatgatatagaggctgaggataccggagaaatgattccccaggaatatgatccggctcagtatggggaggaaacctatacttatgaagatttgccggccgcagcagggccggagtatccggaagcgcagatgcagcctgaagctgccgccgcgccgcagccggattactacgctgtgaaggaggagcctgccgcagctgtacaagagcccgtacaggaaagctcaggaaatccggatccggatctcagcaattatctttcccaggaatatgacgggcagataggcctggtggtgccggacgggtaccaggtggagagacagatcaccggccagatgaacattgaagatatcatgaaagaatgggaaaagatgaagctggaaaatgaggagaagcgccgcaggcagctgcagcagcgagtcatggaacagacggattctctttttcgcgattttgataaaactgccagaaaaggcgttctggagcgtcttcagaaggaagaaaggattcctgtggaacgcaggcgtcctcctgaaaataacgtgatttccgctcataccaaaatctgggcggctgaagaagtggaaaatgccatgaaacggaccgagggagcggcggcggcagtgacggccgctgccgtggtctccgcggcagccggggttgttccggaggcgggaatgaaggaattatcaggaactgccggaaggacagcggaggaagctgcgcagcctgtaccggcgcccgcagtttctcagcccgtaccggcagttccggaagcagagccggtatatgaggagccttccgtgcctgaaccggttcctgccgtgagccggacggcggatccgatacctgaggaggaaccggaagacagacagcctgcttacatagaagagccggaggatgccgcatatgaaccggaaccggagatggatgaagacgccgggccggaaccggaagaagacctggaaaacacacaggagatgaatgcccgcctggaggaggaacgcctggaaaaggaaatccgttccatgagcagggaagaaaagcagctgttcgcttcttttgtacccaccaggggtgctatgaagaagctggtccgtgcgcttgaccagctgagccttgccgcgtatacaggcaatctgatcatcacgggggatccgggttcggacactctgaacttagccaaaaacatcgttaaggatgtacgcgccaaggatcataatttttccggaaagcttgccaaaattgaaggcgacgcattcaataaaaaagacgccggcgagctggttgttaaactggcgggcggcgcacttgtcattgataatgcaggagagatagacgatgagggggcgggaaggcttatggatgccctgaatcaggagcagacaggcatcctggtgatactcatcgatacaaagagaaatataaagaaactgatttccgccaatccggaaatggagtccttctttaatgccaggtttgacatcgaggcgttggataacggtacgcttgtagcctatggctgtcagtacgcgaagatgcaggaatatgccatcgatgaactgggcaggcttgcccttcatacccgcattgaagatatgcagaccagcgatcatatcgttacggtcaatgatgtcagggatattgtggatgaagccattgaccatgccaatcgtaaaacgcccaagcattttatggatgtcctccttgcaaagcgctatgatgatgacgatatgattattctgcatgaaggggatttcatatagatataatccaggccgcttctggcggcggaagagaggtaaaaatggcaggtgtagcaaaaacaaaaaaggcggagaaggtctttatctccgaagccgacgagtatctgtttgcacaggggacgcattatgatatttacaaaaaactgggggcgcatccgtctgtggagaatggaaagaaaggaatgttttttgcagtttgggcgcctcatgccgaacaggtacatgttttcggtacattcaacgaatgggaggaaaaccagtaccccatgaaaaaaaaggggccgggcggaatttatgagctttttattccgggggtaaaaacgggggaaatgtacaagtttctgattacaaccccggacgggcgtaagctttataaggcggatccttttgccaattatgcggaaaaaaggcccggaacggcctccattactacggatatctcccatttgaaatggagcgattccgcctggttggaggaacgggacggtaaagatatgaataaggagcccatggcaatttatgaatgccatattggttcctggatgaagcatccctgtaaggatgaggatggtttttataattacagggagtttgcggacaggcttgttgcctatctgaaggatttaaaattcacccatgtggagcttatggggattgcggagcatcctttcgacggttcctggggatatcaggtgaccggctattatgcgcccacctcccgttatgggacggcagaggactttgcctatctggtaaataccctccaccgcagcggaataggcgttattctggattgggttcccgcccatttccccaaagacgcccacgggctggctgaattcgacggggaggcattgtttgagcatcccgatcccaggctgggagagcatcctgactgggggaccaagatttttaattatggaaagaatgaagtgaagaatttcctgattgccaacgctcttttctggattaaggagttccatatcgacgggctgcgcgtggatgcggttgcctccatgctttatctggattacggcaaaaaggacggggaatgggttcccaataagttcggcagcaataagaatctggaagctattgaatttttcaagcattttaattccgtgatcaggggaaccttccccggggtaatgacaatcgcggaggaatcaacagcctggccgatggtgacggggcctattgataaaggcggcctggacttcagctttaagtggaatatgggctggatgcatgatttctgtgaatacatgaagctggatccctatttccgtaaaaacaatcattattccatgacctttgccatgagctacaacagcgctgaaaattatattctgcctctgtcccatgatgaggtggtgcatctgaaatgctcgatggttaataaaatgcccggcctgcgggcggataaatatgctaacctgagggccggatatgcttatatgttcggtcatgaaggcaaaaaactgctgtttatgggacaggaatttgcccaggaaagggaatggagcgaggaaagggagcttgactggtacatgcttcaggacgagctcaacagcggtatgctggaatatgtaaagttcctgctgaatatgtatcgtaaatatccctgtctccatgaaattgacaatgactggaacgggtttgaatgggtaaatgcagatgatgcggaacgcagtacctacagctttatccggaaagcctccgatggaaaaaataatcttcttttcgtgctgaacatgactccggtggagagaaaggattactgcgtcggcgtacccaggcggaaaaattacaagctggttctgaacagtgacgataaacagtttggaggaaacggagcggaaatcccggcatccatccgggccacatcagaaccctgtgactataagccttatcggattacctttgatcttcctgcttcaagcgcattggtatttgtattctgacatgaataaaaagcacggctttccgggagaggacagctgtgcttttatgtttagaggattgtacaggcctggcggagggcatactattatcaaaccgctgccggacagtccatttttatccggaaaccgcctgttctgaggccttgaggctggcggccttctgcagaaggtatttgtatcttttcatgactgcgttctgttcatatatataacagtcaatcaggtcgggatctgtgacataatcaaaacctgcataggcgttctccaattcacattttgtcttctgtatatccaacatcagactttcctgataagtaaggggcttgtcctctttgttcacgctgccctggctgaaatggaatttcatgaatcatcctcctttgcctgattttgccaaatgaatactttgtaaataagtatatacaggaaaaaggaaaaatatgcatgttatattttttatttttttacatattgtgtagaaaggacagaccgatttgtccggcgtgtgcagaaaaagaaaaacgcctgtcgaaacaagtcgggaacggaggacggatggataatatgaacggaattttaatgataggtattagtttcgctctgattttactcattgcagccatgcggagcaggacggatctgctgattaattttatcatgcgggcggtgctgggaaccctggctatctactttattaatatgtttctggcttctcagggattttcctggcatgtggggatcgggccgttcagtatcgtggtgtcggggtttctggggctcccgggcatcggactgctgtatggaatcaatatctgctctatgctgtgaagggcggcgggtccagtcctgtgtccgcgctggctggcgcattcctcccggcaggaacagaaggcagcccattccccggacagatatcctgtcagcaggtgctgatataccggacattccgatgagcccagggcatccggcgcggcaggtggggctgccgcgtcggattggtctcatcttcatggtatataaagcacctgctgacaggatatctgtccggggaatgggctgccttctgtttctgccgggaggaatgcgcggtcagcgcggacacaggactggaccctgggggtataggaggattaggtgcttggggatcgagggaattgggggactagtgttacaggcggttgttgatgatgtgctgcatggtgatggtggtgcctcttttttggggatcggaggttatggtcatgctgcattttcggccgtagacgagttttaggcgttggttgacgttggagacgcctactttttcgttgcggtctattttgtcggaggagaggatggcgttaagggactgtaggtcggattcggtgatgccgcagccgttgtcggatacttcgtatatgaggcagtcatcctgtatgcggcagcggatggaaatttcccaggggggttcctggccgctgaagccgtggacgatggagttttctacgaggggctggaggataagtttgatggtgcggcagtcgaggcattcgggggaggcgtctacggttatggtgagctgtgatttgtagcgggcctgctggatgttgaggtacatttgggtggtttccagttcgtctgcgacggaaacgatgtagttctcggtgtcgtaggcggtgcgtacgagggaggagagctggtggatcaggtaggtggccatgttgtcgcctttgatttcccggatgatgcttagggaaatgagctggagggtgttgaagaggaaatgagggttgatctgggcctggagggcggcgatctgggcgttcttcagcaggaacattttttcgctcaattcgttggtgatggattcgtttttctgggaaatatcggagatggaattggcgatataaaaaaattcgttgagcaggccgtcgtttttgttcaggatatcgggtttttccaggattttcattacgtccgccacggagcggtactgtcggtaggagaaaaagagggccaggagtatggaggaaagaaaaataacgatgccgctgcttaagaggagcacgttgacgaatttatagttttcctggatgctgtctttctggatgtaggacatgatcagaaggcgggactgggtgcttttggcaacggctatgatgtagtcatcgtagatgatggagtttccctccacgttggtggcggagcggaaggcggcgtaggtgtcttttttctcgaacatctgggtgttgattaagtccggattgtcgcagtagaggatgaggccgatatcgctgactacaaagatctggtcaggcagggtgacgaaggaatcctggatgatggacacaaacttctggtagttcatttccgtacagtacaggcctttgagcttattgttttcgtagatttcgttgcatatgtagagtttggtaaagcggccggtttcgtctgtgcgggggaacatgataaagggcagcttggtactgcggtaggtacggtaccattcgtagaggttgtcggtgccaaggtgtttggtttcccgggaggaaacgcaggtctcatttgcaaagctgtaaataaaaatttcttcagggagagaggaatcctgcaggagtgtgcggatgaactctcttgtttttgtttctgtcccggaactctgtatgggagagtggagaaaatcccgtacatcctgggagttcctggcaagctcataaccggtgtggaagtcttcggtaaggctttcgaagatattttttgactgcagggcgttaattgtggcttgtttggaaagctcctgggtgagtacatatttgtagtaggtaaatatgacaaagaaaaacgggatgaagatgagcaggattgtggtcatggagctgaccacatagcggaaaaaaacgctctttttcccatatttctttatgattgtccatacactgtctttcttcatcgacgttcccccgcggttttcaagacagccggttccggctgtcggtaatcttatattttttcagaactgttctgtatttcataattattccctttcattgtattcgtatttcttttaacccacaagcggaaaaaccccttttcctgcttgtgggttaaagtggtacaaaatgacatgctgaatgtaaagaatgttatattggataaaaaaataaagaaggatatagtaaatgtatcaaatatgtataaaacctaaagggggatttgctatgaatgcgatcaaaaagatggaaaagcaaagcggcttccgtctgttcctgttaatactgcctctgcttatgttggtttttgtgttttcctatatgcctttatatggctggatttatgcattcttcaattataagcccgggaaggcgctcttttcctgtgagttcgtggggctggataattttaaaatgatgttcgccgattcctatgcggtaaaaaatattgtgcgtgtcatgaaaaacacgttcggcatgagcttcctgggaatcctgacctctgtcctgcctatggggtttgccattcttctgtcggagattaagaataagccattccggaaatttgtgcagacgtcggtgacgattcctaattttatcagctgggttctggtatattccatcgcgtatgtcatgttttctgtcaatgacggttttgtgaaccggatgctggtaagcatgggaatcctggatcagggagtgaactttctggcgtcacccaatcatgtgtggctgaccatgacggcctgggggctgtggaaggggcttggatggaatgccatcatgtacatagctgcgctgaccagcattgatgatgagctttatgaagcggccaaaattgacggtgcaggcaggttccagctgatacggcatattacggtaccggggcttcttcccaccttttttgtcctgctgattctttctattgccaacctgctgaataatggcatggaacagtattatatttttcagaatgccatgaataaggaatccattgaggtactggatctgtatgtgtataaccagggtatggtggggtataattattccttttccaccgctgtgagtatgctgaaatcggttgtgagtatcgtgctgcttttctttgccaataccacatccagactggtgagaggggaatccgtattttaaacgggaggaaaatgagaatgaagaaaaaaagacatgcagggcccggggaaatagcattcagcgccggaaattatctgctgatgctggtttttacgcttttatgtattttccctttttattatctgtttatcaataccatcagtgacaatacgctggtgagcaaagggctgataacctttttcccgaaagggatccattttgccaattataaaaaaatatttgagatccgggggcttgtcaattccctgatgatatctgtggcaaggacagtgctgggaacctttctcacattgttcggaacgacttttctgggatatgccttcagcagaaaagagctgtggcacaggacctggtgttaccggtttgttattgtcaccatgtactttaacgcagggatcattccctggtatatcaacatgaaaaacctggggctgaccaataatttccttgcttatattattccgggcatcgtatctccgttttctttagtgctgtttaaaacctatgtggaaagcataccgccatccctggaggaatcggcccagctggacggagcgggatatatgaaacggtatttccatctgattataccgctgtgcaagccgattatagccacactggccgtattttctgcggtggggcagtggaactcttttacggacactttgtttttgatgacggataccaagctgtattcccttcagtatacgctgagccagtacctgaatgaatccaatgcgctggcggaatccctgaggcaggcggcttccgacgggatgcaggtgaatttgtccgcggtgcttacgccgacgtcggtaaagatgacggtttccatggtggcggtaattcctattttgctggtttatccatttttccagagatactttgtgaacggtattatgattggcgccgtgaagggataatcccgcagtgcaaaatacctgacacaatgatattatataattattccaggagggatttcaatgaaaaagagaaacaaaaggattgcagcgatgcttctttccgggcttatgaccttgagcctgacggcctgcgggcagaacgccccggcacagagtacggatgcaggggcgggggaaagcgccgctgctgcagaaaacgtggaactggacgtgctcagcatgcccacaaatacttccggtctggcagaaggctggtgggcggaggaggtggcagatgccgtaggcgtttccatcaatatgattccctgcggggatcaggcggagcagaagctccaggcgctgatggccagcggcgagctgccggatatcgttgtatttaaggactataagcagatgcagaatgcggtggacggggatatgctgctggcgtatgatgactataaggagctgcttccggatttgtatgccaatgcggggacctctctgcagtattgcgcggatattatgaaggacagcgacggaaaatcctacggagtgggaatgaagatcaaaactgatctggaaacaaagggaaccttcgggccttttatccgttacgatctctataaagaaatcggggcgccggaaattaagaatctggatgatttcctgactgtgctgaagcagatgcaggatcttaccccgcagaatgaagacggacagaatgtatatgccatttcccttttcaaggactgggatcgttcttatatgaccatgggtatgtttgcaaccaaaatgatgggaatcaccatgccggatgaaggaagccttgcggagatccattatgattccggtgaacccgtccttacctccatactcagcgaggacagcggttacatgcagtttgtgcgttttgcttatgaggcaaatcagatgggtattctggatccggactcagcaacccagcgttttgaggatgtggtgcagaaggtgacagacggaagggttctgttcatgctggattcctggggtaccagtgatttcagcactatggaaaagcagaataacggcgtgggcttcatgcctgtgcagcctaccggctataaacgtcttgtaaatgccctgcagcccatgggttcctcctgggtgatgtccgtgagcaagtcagccaggaacccggaaaaagccatggaatttatcaactggtattattcctatgagggagcaaggatttcccagaatggccccagggatgtgatttggaaaatggatgaatccaataagccggtgctgacagaaaagtactatgaaatcaataataatccggaagcggaattctcgggcggtaagacgttcgtacagggcagatgccagattccccaggcattctggctttccagtgtggatcctgcctgcggtgcggcagtttccagcacctattgggagaagccttcctatgcgcctgaggatacggctctggtaaaggaatggcaggctgactatggcgcggaagatatgataagctatctgatggctgatgagagccgtatccagatcgagccggtaagcagctatcccacttatacggatgaaatggaacagctgtccgggcgtctgggggatatcgttaaaaccggatcctggaaaatggtattcgcaaaggatgatgcggaatatgaacagctgaaaaatcagatgattgccgatgctcaggaggttggcattgaccgtttcgtggagctgtacggggcggagtatgagaagtgtctggccgatgcggagaaatacgcgcagaaataagagaaataagggggtttgagaggggtatgtattcatttctttttgtggatgatgagaatctgatgagggaattttttgcagaagtggttgattttaaggagtatggctttgaactggcaggcatgtttgccacagcggaatctgccttgtcctttcttgccggacatccggagataaaggcggtaattaccgatattaagatgggaagcatgtccgggatcgatttctgtgaaaaggtgagagaattcaatcaggatatccttctggtggttctgtccggctataaagaatttgaatatgcccagcgggcgctgcgctgtaatgtgttcgactacctgctcaagcccactctttatgaagatattgatatgctgttcaaacgaatgaaaaaacagctggacgctaaggaagaattaaaaaaggaggggccgtccgacggccccgttcttgattatcagtatgaaagcatgatcgggcggatcaaaaaatacatagatgaaaattatgacaaggatatcagcctggacagcgtggcccaatatgtggccatgaatccttcctacatcagccgttttttcaaacagcatacaaaatgcaatttcctggattatgtgtccagggtacgggtggataaggctatcgcctgccttgcggatcctaccatacgggtaggtgagatctgcgagctggtgggctatcggaccccgcagcatttctataaaatttttaaacagtataccggctgtacgccgtcagaatacagaattaacgtcctgggaggaacggaggagccctgatgaataaattaacagttcatattatttcccattcccattgggatcgggaatggtatatgcccctggaaaaacataaactgaagctggtggatctgataaatgataatctggaaatgttatcggaaaatccggagtaccgcagcttccatctggacggacagaccattgtcctggatgattatctggaaatctgtcccgaaaagaagaaagaaataaagaggctggttgaggaaggcagactggtgaccggcccctggtatgtgctgcaggatgaattcctgacaagcggggaagccaatatccgcaatctgctgaccggctgccgggaggcggaggaatatggaaaaaactgcagagtggggtattttccggatgccttcggaaatgtggggcagatgcctcagattttaaaacaggccggtatggaagcagtggttttcggcaggggagtgaagcctgttggttttaacaatgaggcaggatccggtgaatacgaatccgcttattcggagatgtactggggagcccctgacggaagccggcttctcggcatcctgtttgccaactggtacaacaatggcatggaaatccccgtggaggaggaagaggcccgcaaattctgggatgaaaagctgaaaagtgctttgcggtatgcttctaccaaagaactgctgttcatgaacggatgtgatcaccagccggtgcagaaaaacctgtctcaggctatagagacagccagaaggctgtatcctgatattacatttatccattccaattttccagattatattgcccggattaaagaagaggcggaggataagctttcctgtgtaaagggtgagctgacaagccaggatacggatggatggactacactggttaatacctgttctgccagaatctatctgaagcagaagaaccgggaggcagaggctcttctggagaaaacggcggaaccgttatgcaccatggcggcagtcctgggcggggaggggtaccgctatccggagaagaagctgcagtatgcatggaaaatcctgatgcagaatcatccccatgacagtatctgcggatgcagcgtggatgaagtcaatgaagaaatgggaatccgtttccgtcgcagtatgcaggcggcggaggtactaatacgcgaagcggcggagcatttggcagggaatatagatgcttccggattgatgcagcagtatggcgtctgccatccgtttgcggtttttaacactgccggatggaaacggacaggcattgtcaccgcgcagattgacgtggacagagattataggacgaacctcacggaagcttatgatcatatgcagagcctgaaccttccgccctttttcctggtggaccataaaggggaaaggattccctgcaggatacaagatttgggggccgtatttgattatgagcttcccggagacagtttccgcaggccctttatggcgagaaggatacaggctgtctttgaagcggaggagattccctgtgagggctataaggtctttgcgcttgtccctggagaagagggggagtgtaagacggagggagtacgtctggttacaggagaatgccggatggaaaatgcccatatccgtgtggttatccaaaaggacgggacgctggaggttacggataagcacaacggaaacagttaccggaatctctgttattttgaagatacgctggatgcgggaaatgagtatatttatttttgcccggagggaaacaaacccgtgctgtcaaagggcaaagaggcagaaatccggttggcggaagagacggacttccgggcggtatatgagatccggcaaaagctgctgattcctgcttctgcggatgaaaggctggagcaggaacaaaaacggatggtggacttccgggaaagaaaagcgggaagaagcagagaagtaagggagatggagctctgtacttttgttacgctcacaagacttggaagaaaggtggaaatccgcacggaattcgaaaatatggcaaaggaccatcgtctgcgggttatcattcccaccgggatagaaaaggaattccattatgccgattcggtatttgaggtggtaaagcgccccaaccggcacagggcggcctggaaaaaccccagcggctgtgagcatcagcagtatgtgtcggctgtctgtgatgaaaaaggcggaattgccgtggctaataaggggctgtatgaatatgaggtccttccggagcaggagaatgcccttgcggtaactttgcttcgagcggtgggagagatgggggactggggagtatttcccacgccggaagcccaatgtccgggaaaacagagtgcggaatacgaattgatttttttcgatggagattttccggattccggtgcatatgaagaggcgagtatgttccaggcaccctggatcaccgctgctctttcccctgccggggaaaaaggagaaaagtggcttccatcctgtgaaagctttctggagtgggaaggtaaagggatctatctgtccgggctgaaaaagaaggatggggataaggatattatggttcgtttcttcaacgggacggaagaagaaagggaactgtgtctgaaaccggcggcagcgtttggaaaatgccggaaaagcaacgtgctggagcaggagggaaccgtattggaggagaaggaaggggtataccgtctcatggtaaagccctatgagatcataacaataggtataaaggagtagttatggataattataagaacccctctcttcctgtggaagaaagggtaaaggatctgctgtcccgcatgacgctggaagagaaggccgcccagatggatatgataaggggagtggagctggcggagaaggtgcataaggcccatttctgtgcagtggatgaaaactccggatttcaatgggataaagtgcgggagagctgcggagaaagagggatgggcttcgtacatgacgtttattccgttcccgctgtgctgaacaggctgcagaaatatatggtagaggaaacccgtctgggaattccctgtatttttaccggagaggcccttcatgggctttcttatccgggcgccacggtattcccgatgcccattaacctgggcgcagcttttgaccccggactgacacaggaggtgggcgcggctattgctgcggaaacaagaagcctggggattcatgaaatccttgcccccaacctggatctcgcaagagagccccgttggggaagggtggaagaaaccttcggagaggatacctatctgtcctcctgcatggcgtatgccatcgtcacaggagagcagggaggggatatcagccgtccggataaggtggcggcggagcctaagcattactgcgtacacggaataccggaaggaggaaccaactgttcgccggccagggtgggcaggagggaaatcgaaacggattatctcccggtatttgaagcgggggtattaaaagccggcgcttataatgccatggcatcctataactgtattgacggagaagccgtgatttgctcccggcgttatctgcgtcagatactgaaggaacgctatggcctcaagggatacgtgcgtgcggatttcggcgcggtgaaccggctgaaaacctcccatcatatgacggcggattccggagaaagcatccgtatggcggtagatggcggactggatgtccagggctttgatttctccaatcctttctgggaaaaaagcctggtcggccttgtggaggaaggaaagctggaggaatccgttatggatgaagcggtttcccgcatcctgcgtgtgaaatttgaactgggcctgtttgagaatccttatacagaggaaacacattataaagatgtggtacgctgtgaagaacacagaatgctcagccttcgggctgccagagaatctatggtcctgctgcagaacaaaggcggcctgcttccgctcaggggagtaaaatccatagcgctgctgggccccagctcaggacatcagcggatcggaagctattcttcggtgccttatggttacaaggtaccctctttatatgaggaactgaaaaaagcggcgggggatgacatcgtaatacggcagtgtgacggctgcggaatttcagatcgggatatcagcctggtgcctgaatcctggtacgaagacggcgtggagcttacattttataacaatgaccatttcgaaggggagccggcaggaaccaacaggatggagtatattaatttcaactggatcctggcaaagcctcaccgtgatttggaatttaccggttattccgtaaaaatgaaatgcatgctgcatgtggacacccatgtatttaccgaagcggatgaaataaagggcaggcttgtgtttacaaccggagacagcgtaagagtcatggttgacgggaagtgtgtgattgacagcttcggtgatcataagcagaagctgccgggctgtgaattcctgtttgtcaacggcgctgtccatgaggtggaaattgaatatgtctgcgacgtaaacggcaatgacctgaccctgagcatggattttcatgattcttctctggaaaaggcaattgctctggccgaagaatgtgatatgacaatcctggtctgcggggatgataaggtgaccagcggagaaggcatggaccggtgcgatctgaagctttacgggaaacagaaggaactggtggaaagagtgggtgctctggggaaaccttccgtattggtactggaaaacggaaaaccggtggatctgcgggaggaaaccgaaagcatggatgccatactggtggcctggtttggcggggaattgggtgcaaaagccatcgcggaagcgcttttcgggaaaataaatccttccggaaggctgccgatttcctttcctaaaagtgtgggccatattccctgctattattcccggctgccgggagggagccgggaatacctggaaggaaatatcaatgcgctgttcccctttggtttcggactgagctatacggaatttacttaccgggatctggtgattgaaaagagagaagagaaatattcctatcgggcgacagtaaaggtgcgtaatgccggagaacgttttgggacggaagtggcacagctatatataaatgacctgcttagcagcgtggtaagaccggacagactgctgaagggcttctgccgggtggatttggaaccgggggaagaaaaagaagcggaattcctgctggacttcgattcctttaagctgctgaacctggatatggaatgggtggtggagcccggtgattttgagataatcatcggcagcagcagcgccgataccggactttccgggatcatcacggtggaataataaaataatgcgtaaaatacgggctttgccggatattccggcaaagcccgtatttattgagcggggaaatgtttgattgcggctaccggacggggtatggtataatatttttaattatctggaaacagcagtatgattcaggccgacactttcgccggaaaaagaggtgacaggtattgaacaagaagtatataaaattaattgcgatagatatcgctatagccataatcgtagtgattctgtattcgccggggcttatcgcgctgcgggttacggacgaaagtattttcagggcagggatgtccattctggcagggctgggactaatctgtattttcttcagtgtgaatatccgtatgctgcgggatcccaagcccatacttattgcgcctgatgaggtttatgatttggatgaggccaggaaaatcctgagaagccatatggaaagcaggatgttcggcagtattgccaaaaccgcgtcgggacagctggatcgggtacagaaatgccggaaccggattaatgagatcatcgggcggaaatttaccgaaggctccatgagctgggataaatttcaaagcattgttgcaaatgcggaggaatcggcaataaaaaatgtggtcgccatgtccgggagaatgagcatttttgatgaagaagaatatgagcgtctgaagcattataaggaagatgatattccggatgatatccaggaggagcagctgaagctgtatcgtgataattatgaatccacgaaggcggcccttgcattgaatgagaagattctactgaagctggatgcgctggctgtggggctttcttcctttgaaattaatgcaaatgaagatatgaataacgaaatactggaagagatcgaaaagctgacaaatgatgcaaaatattatcaatagtggagacacggaatgggaggagctatgggaaagaataaaatcggcatattggctgcagtcatagtagtcgtatgcgctgttgtgtttggagggatttatcttacaagaaatctgggaaaatccgataaggttatttcacaggaaagcgccttgagcagtcttgaaaaaatggtgaataaaatcagtcccgatacggcggcacctgtaaaatcgcctgtggaatttgatgatgcggaggacgaggcggctgagcttcctgatattgacacttgtgaaataggtacgccggcttccactgccctttatgcagagatttattcctcgccggagaaagccggtacgggaacggatgcatggctctgcgagatggcggaggattttaacagacagggatttaccgttaatgaccaggaggtttccatacaggtcagaaaggtaaacagcggacaggcgctggattatatcgcaacagggaaagcggtgccggatggtttttcgccttccagtatgctttgggttgatatgctcaatgccaaaggcgtggaaacggatgtgataacggagagaatggtgggaaatgttgccggaatcctgctttctgatgctacatataagaaaataacggaaaaatacggaagcgtggatttaaaggcgattacagaggcgacggaagccggcgaattcactatgggatacactaatccctttgccagcagcgccggcctgaatttccttgtatgtacccttgaacggtatgataagagcaatccactttccgaaacggctgtggacgggtttcggaagttccaggagaatgtgcccttcgtggcgctgaccaccatgcagatgagggaagcggcggagagagggacgctggatggttttatcctggagtaccagtcttatcaaaatgattcggcactttccagaaattataaattcacgccgtttggctacagacatgataatccgctggtgagcgtgggggaaaccagtcctgagaaaaaggaaatccttcagaagtttgccgagttttgttcttcggaggaagctgtgaagcgggcggatgagtttggttttaacggcatggaggattatgtgtgtgaatatgacacggtttccggtgatgtgctggtggatgcccagaagctttataaggtaaataaggataacggaaaggctgttataggcgtttttgtgacagatacttcgggaagtatggcaggagctcctctgaatgcactgcaggaatccctgatcaacagtatgaagtatatcaatgccgacaactatatcggtcttgtaagctattcggatgatgtgaccattgaagtgccgatagggaaatttgatttgaaccagcagtctttgtttaagggggcggttgagaatctctatgcctccggcggcacggctacctttgacggtatctgtgtggccatggatatgattaacaaggcgctggaagaaaatcccggcgcaaagccgatgatttttgtcctgagtgatggagagacgaattcgggctacagcctgaatgatatcagaaatgtgctgagcggtctgaaaatacccgtttataccataggatataatgcggatcttgcggccttgcagagcatcagcgccgtaaatgaggcggccagcatcgatgcttccaccgacgatgtagtgtaccagttaaagaatctgtttaatgcgaatatgtaaatagggggataggaatatgggagatttttcactggatttacccaggactgaagaaataaagaaggaagtggaaaaggaactggcgcctaccaatgaggataaagcgctcattgataatacgatgaaggaaaaggctgagatgatcatgggcgtcgatttggattctcttgcggaaagaagagaatttgtacaggtgatcgagacctttggcgcggatattattaaaaagtcttccgtaaaaaacagtatccttcagaaaagaatgggggatttcagcaaggcaggcggagaaacgagcgagatttcacggggcctggctgatctttccataaaaatgagggatctggatccctctgccctggatttcacgaaaacggggccgctgggcaaaatatttaaccctatccgccgttatttcgaacggtataaaacagctgacgccgagattgcatccattgtgaaaacgctggataagggcaagaatatgcttaagaatgataatacaacgcttgaaatcgaacaggccgacatgcgggatcttacaaagcagctggcacagagaatagagatgggaacccagctggatatgtatttatccaatgcggtggagaacgccgaggcggcgggggaagatgaggagaagattaaattcatcaaggaagaaatcctgtttccgctgcgtcagaggctgatggatttccagcagctgctggtggtgaatcagcagggaatcatagccatggaagtgatccgcaagaacaatctggagcttatccgggcggtagaccgtgcggaaacggtgactatctcgtcgctgcgggtggctgtgactgttgcgggcgcgctgtataatcagaaaatcgtgcttgaaaaggttcagatgctgaatgaaacgactaacaatatgattctgtccacctccaagatgctgaaggagcagggagttgctattcagcgggaggcggtggaggccagtatttctccggatacgctgaagcaagcgtttgcggatacgatttctgcgctggatgatatcagtgcgtataaggcgaaggcgctgcctcagattgcgcggacgatcgaggagtttaaggaaatcgccgtggagggggagaagcagcttcagaaattggagaagagtcgtaatgtagaattgtaggcagtggggggagggcggataaacggaaccgtcacaggaccgcgttctctctggtgtggtatcagtccgggggcgggatttttccttcctccgggggccggctgtatatgtgttttcggctccagcttcaaaaacggtgatgtttctaaatgttccgttctgtcgggagtctgccaacgcggcagaactcctcattgcagcgactttcagtcggctgcattcgtcagacatgccgctaagggcggcagtctcccggcagaatggagcattaagaaacatcgccgttttttcagatggagctgaaaacacatatacagccggcccccggaggaaggaaaaatcccgcccccggactgatatcataccagagagcgcggccctgtgacggttccgtttatcctgggggtatgggtggcggggatgggggttatatttggcgcatgtagatggtgtcgtagtctccggcgtagttttttagggtgtctatgggggtgaagccgtatttttcgtagaagtttttgaggtctgaggggatgtatactttggtaaagttttttgattgggcgtaggtgatggcggtttggattagtttgtggcttagtttttttcctcgggcggtttcggttacgaatatgctgctgatccatggggagtatttgttttcggggtagtagtcttctttcaggaaggagcagtgggcgatgattttttggttttctgttgctataaagaaggcttcccagtctgtaaatctgttttctcttagcattcctgctatgtgtctgcctggtgtccaggatgaattttcggcaaagtctattgtttgtttccagagtggtgtgttgtgtttcagttgtattatttccatggggggcctccgtttttttaatggttttggaatttttgggatgagttgttgggggggctgggaataaggctgcggtattggcagtattttggtatggcgggggtattgggttaattgtatcatatttttggagagtggatttgatttttttaattgggtatttttgataatttgtagaaggatgtgggggaaagtgtttaatttttttggagtattgacaggagggaggtgtgggggtatactgtgcttatagtgcatgcacagtatgatagtgtggaggtgaggggaactgaatattattattgtgaattctgcggatgtgcctatttatgagcagattaagaatcaaataaaggctgctattttggcgggggagctggaggagggggatgttttgccttctgtgcggaatctggcgagggatttgaactgcagtgttattactacgcgaaaggcgtatgaggggctggaggcggaggggtttacaatcaatatggcggggaaggggtcttttgtggcgccgcagaatatggagcttttgcgggaaacccggcttgcggaaattgaaaggaaacttacagatatcatggaatacgcaaggcccgtagggattacgggggcggatttgaaaacgattatagacgaattgagtcgggaggattaggggttggaaacggttttagagataaaagggctttgtaaaagctatggggattttgggctgcgtaatttgaatttgtctcttgaaaaagggactttgacgggcttcatagggcctaacggggcggggaaaacgacgactatcaagagtatattgaatatgattgctccggacgcgggaacgatccgggttttggggatggacagtgtttcgggtgatttggaaattaagtctaagcttgggatcgtgcttgatgatggtcatttttatgaggatttaactttgaagaaaatgaaaaatctgattgcacccatgtatcctgtttggaatgagggcgcttatcagtcctatatggagaagttctcactgccggaggagaagaaaattaaggacttgtcaagagggatgaggatgaagtatgcgcttgtgcttgcgttgtcacatgaggcggagctttttattttggacgagcctacttcggggctggatcctttggtgagaggggagttaatagaaattctcaaggatattgtgcttgaggagaataagactgttttgatgtcgacacatattacttccgatcttgataaaattgcggattatctgttttttctgtttgatggtcagattatccttcaggggcagaaggatgagataaaagagcggcatgctgtcgtgaaaggtgatgcttcggcgctgccgccggattatgagaattattttgtggggattagcaaatcggcttatggctttgaggggctgacggataagaaagcggctcttaaaaagctgctgccggttaatgcggtttatgaggttccgacaattgaggatatcatgctctactatataagtccagctaagaaatgtcaagaaataaagtgaaaaatgtttaaaaagtttttttgagcagttggtgtaaaaaaaggcgactttaataaacccatcggatatgggaatttaaaaatttcatagtggtggatctttaagctgctgtttctgttttggcagactgttctgtcacatagcgtttacaatgctcttcgggtgtaatgatctcaaaaggtttgttatcccgcagcatagcgaaaatgatgttgcagattttatgcataacggctccgacagcaaccctctttttcttgctggcacatttgcgggtgtaatagtcataaataaccgggtttacaggtgtttttatccctttctccatttttaagttgtttatggcaatcatatgcaggatacgacgcgcaagaccggacccccgcttggacatgtggaccctgtctcccctgagcttgccggaatcatttacaccgggatccaacccaaagtaagcatagagcttcttgggtgaaggaaataagtcaaaggaacccatttctgcgattaggacaacagcgcttaaaaagccgatgccgcgcagggactgtaggagacggatgcggttatatgcaggattcccctgaagtctatctacagccttgtgcagttcttgcagaatggagtccagatgcccctggtattcccggtaagaatctatgtacagcctaatccggagggcattgctgggaagggcgcgcccgaacaattcggaatctttcgcggcagtgtataaggcgtcatacctggcaagggcatacatttccccaaagcgtgctgtgctccggatggttttgatgatgtcatcctttggagcggcaagcatgtccctggcaagagggtatgcatatagaaggtttaaggaagtctgcgtggtgatcttactgaacacctgtaggtaagcggggaaggaaactttcagttctgcatgtagtttgagaacgaccgccgactgtaggtctttgaagtaatagtaatcacggaccaggttccgtaggtcgatgatctcatcgtccggaacgatggaagtctttagggaagcatccagtccaactctagccgctttttttgaatcaaatttgtcattatgcagtttccttacgttcatatttgtgctattcttagtgatgataggattaatgacggagcagtcaaaccccttatcacgaaggaagcacaggagcgggatgtgatagatcccggtggactcaaggaagcagcggcttttgagagaatacgtctcttgtgcttcctttatttttgtgacagcaagctcacgggactgcggatcggagtggatgatcttaaagggttttccagtgaggaggccatttgggagcatgatggacatccaggtgaaatcagcgccgacatcaagccctacagagagataggggatgctttccagcatcttgagaactttttgatagtgcataacttgatcctttctggcaggtatccaattccagaaggtggatacacaacctagcgggttatacaggtatagcctggggcatcccaaccagccaaaacataaatcaccaccgaatggactgacagacttttttagaggtttcaccagccaaaaggccggttcccaaggaggaaacgtccataatcctgccttccgtgattatacctctatcttttgtctggtgcatgaaggaaacctcaggcaaggtaaataaggttgccttataacttctgatggagggagaactcctccttccgttatatctatatagattgattagattggactttgtaacttttaacttagtagtcgttcttgactacaccattattatactaggaggaataaataatgcgtgcaaactttcttaattttactaaaatgcaggtttcttcattgagtcagatcgtttggctgcagcttcttgggatagttttgtttcctatgttttttcacccggttaacaggaataacgatcttgccaatgttgttatttttgctacggggcttttgatgctttcctatctgctgcttcgtaattttatgttcaatgatgcaaagtataaaacgaagctgctgttcagtatattgccggtaacgcctggctcgattataggggccagaagtgtaattgtttatttgttttgtctcgctgtatcgccgcttttattgttgttttctaatgtaacacatctgataaagccggggatgtttgctgttattcagtcgcatatcgttccttacagcctggtgctgattgctgttatcatgccgatagagtttcttatattttatgtgtttgaggggcagaaagcggatattgtcggtgcatttgccatgtttccgtatatggggctcatggtgctgctgtatcattatatgatgaagggattactgtggattgtggtgttttttattgccgctgtcatgaatattgtttgtttcagattttctgtatggatgtataagaataaggtgtagtcaccagctttatcaatggcatattagaaaagaattgctttatgacggatgcgtctcctgggtttttgcaggggcgcatctttttgtgtccttttcttttaattaagtaatagtttccggagtaaagggtcttgctggcctggaagggttgtaatgggctgtgcatggcataatttgtttgcagagggatttttatgtcgaatgatataaatgatatatttaatataaataatataaaaatgcttgcatgttataatgattggtgttattatatgtacatattaacgaggctggtatatagattgattaaaagtgaacggttaaaatgaccataaacagcgtgaatagcaagaaaaaatgtaatttggcagaaaagctgctgaaaatggtataaaataaatgatataaataacataaatggtataagtaaacggaaagtgctgattatcaccaagaaggagtgagagcatgagaaagaaagaaaaaagggtagtggaagagaaggttgttgggaagcaggaccggatggggaggctgtttgtagctcctccggtaatattatttcttttgtttacgcttctgccaatgattatggcgattgggctgagctttaccaagtatgatgtcattaacccgccgaggcttgtggggctggcaaatttccggaagatgataaaggatgaatttttctggattgcgcttaagaatacgtgtgtgtatacggtgatgtatgttccggcggggctgctgctttctctgggagcggcgatgtttctgaatgcggatcagaagatggtggggctgttccggactttgttttatctgccggtgctttcgtcaacagtcgctacggcaacgctgtggttctggatcctgaatcctcagctgggtctgctgaatgggattctggaattgttcgggatcagcggaaaggcctggctgtatgattccaagctggcgatgttttctattgtcctcatgagcctatgggcaggcttcggggggaatatgatgattttcctggcagggctgaaggggattccgcctatttactatgaggcggctaagatcgaaggagccagcaggtggcagatgtttacgaaaattacaatgccttctataacaaaaacgaccttccttgtttcaaccatgctgattatcggtaccttccaggtgtttgatcaggcttttgtgctcacgaagggcgggccgggtaatgcgaccattaccattgtttattacatatataataacggatttaaaaacctggatatggggtatgcatccagcatttcactggtattgtttgcgattatcctggtgatgacagtgataaacagcaagattaacaaagcggatctttaagggggaggaagaaaatgagcagaagaacggctaaaaatataaaaagtgttttctggtacataggcgcgtttatcatatctctgattacggtatatccgtttttgtggatgattgccacatcatttaagccggaggcggagatttattccagttccctttcccttttttcagaaaatttttcgctggctaattacaccaaggtgtttgatacgatacctttcggcaggtattttatgaattccctgtttctggctgtggcgggagtgcttaccaatatttttctgggtgcgctggccggatattccttcgcgaagcttaagttcaagggaagaaagaccatgttttccctgctgctttcttccatgatgattccgggcgtcattaccatgattcctcagttcctggtactaaaaaactttccgttagtgggaggaaacaatattttcgggcagggagggcagggcttcatcaaccattatgcggcaataattcttcccggcgcggtgggagcctatgcggttttcttcatgaagcagttttttgaaacgctgccggatgatttggcggaggccgccaggatggacggctgcagtgagttccgtattttctggaatatttatctgccgttgattctgcctgcggcgataacattgggaatcatgacgtttcagtcggggtggaacagttttatgtggcctatgatagttttgaattccaaggaaatgatgacgattcaggtagggctttccactttccagtatcagtacaatacgatgtacggtccgctgatggcgggaaccgttattgctacgatacctacactgctggtatttgtttttgcacagaagtactatatccagggtattgctttcagcggaggaaaggaataggaacggatcactcaggtcaggccagatgccgtaagacatttgttcaggtataaaaaagtgaaatgacagtgcgtatgcacggaagggagtttactatgaaaagaaaagcattagcgctgctgcttgcggcagtaatgacgacagccatgctggcaggatgcggcaaaacccagacaggaggaagcgacggggcttcccagggaacaacaccggcggggactgaaaaggaagccgatgcttcttctgcgggcagcggagagaaagcagagcttaccatgtggggaagctggagcggtgaccaggtggcacagctggaaaagcagctggagggctttaacaattcccaggataaatatcatgtgacctatatggttcaggacggcatggagcagaagctgctgacggctatagccagcaatgaggtgcccgacatcgttttatgggatcgtttcaatacgggagtctatgcgccgaaaggagctcttgcgtctctggatgattatattgcaaaagataatgtggatatgacccagttttatgcgcccgctgtggatgagatgacgtccgcaggtgtggtttacggaattcctcttaccgtagactccagagtgttattctataataaggatcttctggatgaagcaggcgtggatcccgcttccattaccgattgggacagtctgagggatgcggcgattaagctgacaaaatgggacggcgacaagctggttcagtccggattttctctgaaggatgttggtctgttcaataactggattggccaggccggcggaaaaatgatagacgacagcaccaatccccctacggccgcttttaatacggaagcaggtcttacagtgctcaaatactgggatcagttattgaaccaggacaaagtttatcagcttggttttgaagacggcttcggcggcgacggattcaaagcgggtaaggtggcaatcacatttaacggcccctggactctggaatcctataaagaagcaggccttaacttcggtgttatcggtcagcctcagggctataacggtgaaaagtccgcaatgatgggcggtttcggtctggtaatccccaatggggctaagaacccggatgcatcctgggagttcatcaaatggtggacaatgcagcctgaaaacggtgtggaattctgcaaaatcagcggtaaccttcctgccaataaagaagctgcaaaggatccttattttatggatgatgatatactgagagtattttcggaaaccatggactatgcgggaatccgttccaaggtgttcggatactctgatttggaggggcttgccctgattccccagcttcagaaatatgtagctggtgagattacagcagaggaagctctgagtaatgcggagaaacagggaaatgatatccttgcggaagcggcacagcagtaatcttttgtctgggctgcggtgataagatttgagtacagggtctgcctgaagctgtggcaggccctgttttaaaaggagcaggattcagccggaaggagagaaggcaacgatgaaaaaaatagaagaggtatgtgaaagggcgcagtatgcgctctggaacaggttctgggataatgagaaagaagtatttgtcaatcattatccggtaaaggaagaggaatcgtggatttactggtggcatgcccatgcgctggatgctttgctggacgggtttgtcagaacgaaggaaaattactatctggagcgttttgaggcggaatatgaaggcgccttccgggaaaatggaggcacctttctgcataactggtatgatgatatggagtggatgacgctcgccctcatccgcgcttttgatattaccggagaaaaaaggtacatagagcaggccgtctatatttggaatgatatcaaaacggcatggaatgacagctgcggcggaggcatggcctggaaaaaggatcagctggattataaaaatacgccggcaaacgcaccggctgccattatcgctttccggctttatcagagactccacagggaagaggatcgggaatggggagagaaaattctcaaatggaacctggatcacctcatggatccggatacctgtttcatatgggacggtatgaacaggctgggtgacgggaaggtggattatgaatggaagtttacctattgtcagggagtggttatcggcgcggccatggaatatgcaaggatcaccaataataaggaatatctggatcttgcgggaaaagtggcgcgcagggcggtgacggagctggcggatgcggacggcatctttccctatgaaggccccgatgactgcgggctgttccggggaatttatttccggtatgtgtatgagctgacacaggagtcttccgaatacgaggatctcaaggaaatcataaaaaagaatgcccggatgatagcggaaaatggtatgaacaaggatggcctggtcggcggagactggagacagaagtctgaaggaaccatagatcttgcacagcacctgagcgccgttatgacgctggaaatggcggcaaagctgggtgacagttaacctgtctgtattgctgcagaactggaaacgcagaactgatatcctgcttggaacatcacaggaaaaggagacttctatgaaaaaaatacacttgatctgcaacgcccatctggacccggtatggctgtggagatgggaggagggctgtacggaggcattatccacctttcgtacggcggaaaggtttacggacgaatttcccggttttacctttaatcacaacgaagctattttatatcagtgggtaaaggaaaatgagccggatctctacgaacggataaaagaaaaggtaaaggaaggaagctggaaaatcatgggcggatggtacctccagcccgactgcaacatgccttccggggaatccataatccggaatattgcggagggcaggcggttttttatggaggaattcggaaagcgcccgaccacggcaattaattttgattcctttggacattcccggggcctggtgcagattctgaatcaggcaggctttgattcctatgtggtctgccgtccggcaaaggataactttgactttacgagccagaattatcgctggaaaggcttcaacggttccgaagtgattgtacacagatcggacgaaaattataattccgttcatggacatgcggcggaagaactggaaaaattcctgaatgaaacgagagaagaggaagtatctttgtttctctggggagtgggagatcatggcggcggggcatccgcacaggatctgaaggatctggagagaatgcttcaggaacgaaaggaagaatactgcattatccattccgacgtggaaagctttttccatgagctcagggaatcaggtgaggagcttccgctggtggaaagagggctgaatccggtggcggaagggtgttatacctcacagatacgggtgaagcagaagcacaggcttctggaaaatgaaatttacagcggagaaaagatgttttctgaagcttcccttctttatggaagggaataccctgcccgggctgttcacgaggcggttaaggatcttctttttgccgagttccacgatgccctgccgggctccggtacgcagcttgtggaggaggatacacttcggcttctggatcatgggctggagattatgtccagggaaaaaatgaaagcggggattgcgctgacagccggagaggaagcgatcgaggacggcacctcctgtgtctttatttataatccccatccttatgaaattaccggacagttcgcctttgaggcagggctgccgaagcagaactgggaggatgtattttattatccggaatgctcctgtaatggggagcctgtgaaaacccagggtgagatggaaagcagtcatttttgtatagactggcgtaaaaaagtggtgattgtggcgacgctgaagcccgcatgtatgaaccggatcgatatccgtttccgtgccattcccaagaggccggtattccagccgatttcagggaaaaaggagtatgtatttgacaatggggccatgcgtgtggtgatcaacaccgctaccggactgatggactcttaccaggttgacggaatggagtatataaagcccggaagcttccggctgacagcttatgatgatacctataattcctgggggcttcgcacgccggaaagctgcggggaaagaaatctgacactgctcacccctcatgaaggaagcgctttttccggactggcggataaggtggtgccttcggttaaggtaatagaggacggccctgtccgtaccgttgtggaggcgctgttcggctggcatgagtcgaaagcataccaacgctatattttcccgaaggaaggaaccgcttttgaaatagaaacaggggtttattggaatgaaaaggataccttcctgaagctgaatatccaggcggcgtatgagagcggcgaatatctgggacaggtgatgttcggcagggaaacgctgcggcaggaaaacagggaagtagtggcgcagaaatggaatgccttcgtgaatgaggataaggcgctgactgtcattaactgcggaacccacggcagcagcatcaatgccggcaaaatagggcttacccttctcagaagcgcaggctacagcgcggcggacggcaattttgagcgcacgctccgggaagaaagacatacggtgagaatggaacagggagagcggattttccggttccggatagaggcaggaaagcccggagagcttatggacggtcttgacaggaaggcgcagatttttaatgaagcgccatatgcgtttgcctttaacccgtctggaaaaggggaaaagagaggggagctaatcacaattgataatcccgcggttattatgtcggcgtttaaaaaggcggcctcaaaagacggctatattatccgtgtctatgaatcagcaggcaaaaaggaaaaagcggagctgaagttctctgcctggaaaaccgtatatacgctggaattcaatccttttgaaattaagaccttattcctggatggaaaaacaggcatggtttcggaagcggatttgctggattaacagatatgcaggtcatgcagcaaaaaggtcaggagctggtatgagaaaaataatatattctgttttgtatgtgacggcggccgttttctgtattttcctggcggcagccgccgtctgcggctgttcggggatggacggtgcagcgggaaacatgacaggaaaagaagaaaaacgactgaatgaggagatggcagaaaagatggatagacgattgccggaagaagtgaaaagggaacagattggcaaagatacggccgttgcggcgatggatcggtttcttgccaagttttatgtaatgtctgatgacggtaccggggctatcgtgggcgagcagttctggccccgtgccgaaatcatggaaattgcagtggatgcctgggaaaaaacctccagtccgcaatacagagatttgatggagcagatgtatctgggattcgtaaaggattttggagaggactggtccgataatgaatataatgatgatattatctggataacaatagcgtgtgcaagggcgtgtcaggcggaagaaaatgaagtttataaggaacaggcagtcaaacatttcaatctggtttacgacagggcatggagtgaggatttgggcggcggcctgttctggaggacggataataaaaccaaaaattcatgtatcaacggcccggccgcaatagcggcgtgtatcctgtaccagattacaggggagcaggaatatctggaaaaggcggtcaggatatacgattggcagtgcgaaaatctggttggggaagacggggcggtttatgatgcctatgatctggaaaagggaatcaataaatggtgctccacctataatcagggaacctttatcggcgcgggcctttgcctgtaccggataacaggggaagaaaagtatctggaaaattcggtgaaagcggcggattataccatgaatgtcatgtatcagggcggcgttatcaatacggaggacgagggaaatgatctgcccggcttcaagggaatactggcaagatggctcggtaagctggtctatgaaggcggacagacgcaataccttgactggatggagaaaaatgcgcagacagcatggcggaacagaaacagcagtgatattatgtggaccaggtgggcggataaaacgcaggataccttttataccgcatggggctgttctgccgcggtttcacagctgtggaactgtcttccgccttccggttatgaggaaaatgctgtaaatccttaaaaagaatcccgaaagcaattgaaaatgatatgctcaaatgttaaaatgaattaaatgatatatcatttaatgcgcaggagggagccgaatgaaacaattgccgctttatgaacagatatacaatgatattattgaaggtattgaaaacggaacctacaaaaaaggagacaggctgccgtctgaaaaagaattgtcggagaagtactgtgtcagcaggataacgagcaaaaaagcgctggagctgctggcggaggagggcaggattatccggatggcaggaaaaggttcctttgtttccggagcggagctgacagaagaggttcaggcggcggaggaagcggagagaaatcccaatcgtctgataggcgtgattatggacggcttcgggccgagcttcggctgccgcctgctgggaagcctggaaatggaatgcaaaaaccagggcttcagcatggtgctccgctgctcttacggaaatatagaagaagaaaccagggccattgatgagctgcttcagattggcgtggaaggcatcatcatcatgtgtgtccatgatgaaaattataattcaaaggtattgcagcttgtggtggagcgattccccatagtgaccattgacaggcagctgaaaggaataccgctttcctttgtagggacgaataatgaagaggcggcaagggaactggccaactatcttctgaatgaaggctataaaaaaatatgctttgccatgccggcttccagagagacctccactattgtggaacgtcagaacggtctcaccatggctttccgcgaacacggaatgattgctgacgagtccttatggataaccgatttaaaggctaccctgcccagcagccgttctgaagaaaacctggaacgggatatgcggcggattacaaagtttatggaaagccatcgggaggttgaggccttttttgccgtggagtacagtattgcaagaattatttaccgctgcctgtatcatatgaatcttcataaaaaatgccctgtggtctgttttgacagcagtgacaacattattcaggaaagcatgttcacccatgtgcgccaggacgaggatacgattggccataccagcgtccgtctgctggcggatgcgctgaacggcattaaggagcccaagactgtccttgtgccctaccagatcattgaggctacggaaaacggatacgattgaaattaaaaaatatataaggcgctgcaggtgacggaggcaggaaaggccgtacactttcataaaaaacgcgcagataaggagtactatgaaaatcccttcaattcttataaataaggcaaaagagctggaagaatactataagattcattataaaccgctggcccctttggcggcccgttgttttctgaacaccatggaaaccacggtaaagcagctggaggacggcagctattttgtgatcacgggagatattcccgccatgtggctgagagactccgcggctcaggtgaggccctatgtaaagtatgcggcacaggacagggagcttggggatatcattgagggagtcatcgccaaacaggcggaatttgtctgcctggacccttatgcgaatgcattcaacgagagggcggacggttcgggacacaaggatgaaacagaaaataatgaccatgtgtgggaacgcaagtatgaggtggattccctctgcgcgcccctgtatctcggacatgcatactggaaagcgaccggggtaaccggaattttcacaccggtttataaggaaatgatcgtgcgcattctggaaacctttataacagaacaggatcacagccgctcaaaatacttttttaccagacacgactgtgtgaaaacagatacacttcccgcaggcggaaagggcaggcctgtaaatgttacgggcatgacctggtcgggcttccgtccgtcggacgactgctgtaaattcggatatctgatccctgccaatatgatggcggttaccgcattgggatatgcggaggaaatcagcagggatgtgtatggggacgtggaactggcaggccgctgtaaggcgctggcggaagagatccgagacggaattatggattatggcgtggtgaatcatcataaatacggccggatatatgcctatgaaacggacggcttcggcaactataacctgatggatgacgccaactcccccagccttctggcaatgccgtatctgggatactgcagcagggaggatgaactgtatcagaatacaagacgctttattctttcggaggataatccctattataatgccggaagcagggcggcaggaatgggaagcccccatacgccggagggctatgtatggcatatcggcataatcatgcaggctcttacgtcaacggataaaaaagagatcgggaactgtctggaaatgctggccgatacccatgccggtaccaattacatgcatgaatcatttaatccagaggaaccggaagaatttacaagaccatggtttgcctgggcaaacagcctttttggggagctgctcgggacactgatggaacagggattttttgacggagaagaaaaataagcagggctgataactgtttgtttgacacctgggaaaccagtgttttccaggtgtttcccgtttttttatgtactttatccggagcagtttgttacaaattaacaaaaatattttattttgtaaaacggtctggacaaatgaaaacacatgatttatacttcattttaccaatcaaaaacagctgccttctgacggcagtattgcttttgcattatcacaattcttttcggctgaggcctcagcatttcttgtttttttcgcattccggccatgcggcaggaacgcagttcacttatgaattcccattatttattttatcaggcagttgccggagtatagcttgaagcagtacggattttggttttctgccgggaggtatgattgaaaaagaatattttggcagtttgcgacacggagcaggaatttacctgtcaccttacggattatctggggcagctggcaggaagcgacagctttcccttcgaggttcaggtatttacagattcccgggcgttagaggaattctgcggtaagaaccgggcggcttttcttctgctgacccaggaggtataccgggaggcgctggactgggaggatgattcctggaaaatggccaggcttctcattctggaggaagaaggagaggcgccgccgggactggagcgggtaaataaataccagtccatggataatattgtccgcaaaattatggaaatagcagcggatgcaggaattcttcctcccgcggctgtgggggaaagaagcggaaacgttcatttcatcggaatctatacgccggtaagccggtgtcttcaaaccacattttctttcacattgggccagcttctggcccgcagacacaaggtactttatctgaattttgagagctattccgggctggcccgcatgctgcagcgggagttcagcacagacctgtcggatctgatttattttctccacaatggagacgacaggttcccttaccggctggagggaatggtacagaaggtgaacgggcttgcgtttattccgccggtattttcctgtatggatctgcagcgtattgaggcggaggaatggctgcggctgtttgaagaactggacatctccgggagctatgaatacgtccttctggatctgtcggaggctgtacaggggctgtttgatatcctgaggctttgtaccagagtgtataccattaccagagacgacggctttgctgcggccaagcaggaacaatatgaagagcttctgcgatgcctggactgtgaagatattctgcgcaaaaccagaaaattccgccttcccctgttccggcagctgcccgcggggcttgagaacctcacccatagtgagctggcggcactggtgcaggagatcatccgggaggattggaaggatgcgtagagtgtaaggaggataaggatggaacaggaaaagtatctggaaaccaaggaagaaatccggagggagcttttggagcatatggatttttcccgggaactgtcggatgaggatatccgggacgccatagcggatcggctgcgcgccagagaattcggcggcaggatgaatgtatatgagagggcaaggcttggcaaagagcttttttatacgatccggggactggatgtgcttcaggagctgattgaggacagtcaggttacggagattatgaacaacgggctggaagggatatttgtggaacgggcaggcagattgtttccctggcccttcggatttgaatccgcagaaaagctgcaggatgtcatccagcagatcgtggctggctgcaaccgggtggtgaatgagacctctcccattgtggatgccaggctggaaaacggttccagggtaaatgtggtgctgggccccatcgctctgaacggcccggtggtcaccatccgccgttttcctgaagagcctatagggatggacgaactgcttgccatgggctccgtcagtgaagaagcctgccgattcctggaaaagctggtaagggccaggtataacatcttcataagcggaggaaccggaagcggaaaaaccacttttctgaatgcgctggcgggattcatcccgagtgatgagaggctgattaccattgaagacagcgccgagcttcaaatcagggggattcccaatttggtgcgcatggaaacgaggaatgccaacgtggagggatgccggcccatcaccatacgggatttgattaagacgtcccttagaatgaggccggacagaataatcgttggcgaggtgcgcggcggggaagccgtggatctgatcggaagcgccttgaactgcggccatgacggctccatgtccacaggccatgccaacagtgccagagatatgctcatgcggctggaaacaatgatgctgatgggagtggagcttcccctgcccgccatacgaagacagatcgcatccggggtggatataatcgtccatctgggcaggcttcgggacaaaacaaggaaggtactggaaatcgctgaggttaccgggtttgaggatggagaaataaccctatccccgttatatgcctttgaggaagaagaaggaaccgcaggaaataaggttatgggaaagctggtaagaaaggaggagctcgtccatgcagataagcttaaaatggcagggatttccctggcgtagcaggaaaggagaggaacaggaaaaggaacacgcccctgattatggacggtattccttccgcaaaaaggagattttgataaatggggtgaaagggataggagcagctgctctgctgtcctggtttttctatcactccttctgggccatgctgcccctgtcgcccatcgtctttttctcctttcgggaaatggaaaaggagctgatccgcaaacagcagcaacagctcgcggatcaatttaaggatgccatcctttcggtggcggccgggcttcaggcggggtactccattgaaaatgcgttcctcgaggcgggcagggatatggaacgcctttacggagccgacagcctgatggcgaaagaaatacgttatatgaaaaaggggctgaggaatcatgtgcctctggaaatccttcttgtagatctgggaagaagaagcaaggaggcggatatggaggactttgcccaggtttttgccatcgccaagcgctcaggcggaaatctgaacgccatcatacggcgcagcgccgccataaccggagaaaaaattgaggtaaaaagagagatacgcacgcttctctcctccagacgctatgaacagcggatcatgaatatggtgccgtttctgataatggcctatcttcagcttacctcaaaaggtttttttgactgtctttatttcaatactgccgggattctcatcatgaccggctgtctggcactatatcttgccgcttttctgatatccagaaaaatgatagaaatcgaggtttgaattatgtgggtgatctatgtgggagcactgacgggaatccttgtcttattttgggccagccgcagtacaaaagcggatgccaatgcggatgcacccgtattcgtgcgtatctttttccggccggcagtatggctttgcacctgtttcccaaaacagataaaggggagagaaaagggaaaatggccgcagggaaatccgcgtcttcaggaggatatggaaatactgtatccctgggaaacgcaggaacgcatgcggatatatacggcggaaaaagtgagcacttttctgtttattgtgaccgtcggagcctttctggccgccgctttctccctttccgcacatttggataaaagcctgtccgagggagatatcctctaccggaattcttatggaggaggcacacggcaggtgaacctggaagccagggaggaaaaaagaagagaagagattcaggttgaacttcaggaaagggaatataccagaaaacagctggaggatatgctgcccggactgagagaagccctttataaggaagccgccggagaaaatccgagcctggatgaggttaccgaagacctgtattttccctcctccattccgggatatccttttgaaataacgtgggaatgtgaaaattacgagctggttcagagtgatggaaaggttcggaatgaggaagttagggagaaaggggaggtagtggagctctgtgcggtgcttacctgctatgaacagcgatgggaggaattcttttccgtacggatatgcccgcccgttttgacagaagaagaacggttccgaaagcttttgacggatgcggttatggaaaaggagaaggtctcccggacaaaggaagggtttgcgcttcccaaacaaatagataaaaggcctgttttctggaaggaaaaaatacaggacaacagtttcatgctttttatcctgtttcttgccgcaggcgcctgcctgtatcggttccaggacagagatctgaagaagaagagaaaggaaagggaggagcagctgctcctgtcatatccggaatttatcagcaagcttgtcctgctcatgggagccgggcttccggtaaggagcgcatttatgcggatggcctctgactacagaaataaaagggcaggcggaagcggtgtggtttatgtatatgaggaattgacgctggtatgccgggaaatggaaagcggcattacggaaacgcaggcttatgaacatttcgggcagcggtgccggttaacccagtaccgtaaatgcagcgcgctgctcagccaaaacctgaaaaaaggagcttccggacttctggacgcgctgcaggaggagtcggagcatgcctttgaggaacgtaaaagaaatgcaagagaggccggcgaaaaagcagggacgaaattgcttcttcccatgatgatgatgcttgtggtggtaatggtactgattatggtaccggcctgtttttcctttgccgggatgtaaatgaaaattaaattttagaatttatcggccgaaaggcggaacggaggaatatatgaaaaaaatttattggcgtacggtaaacggagcggttcacatgaaaaaccgtgtcggagaaattcttaagggagaagaaggaatggggaccgtggaggttatattaatcattctggtgcttatcggactggtaattatatttaaaaaccagctgaccagccttgtgaattccattttcgggaagataacctcccaggccggaagtatttaattaaaaggagatatgccgtgaaacgaggatacattacggtttatctgtctctggttaccggaatcctgctgtctttgctgctcacggttatggaaggcgtgcggatgcataccatccgcacacagacagaatgcgtgatggatatggctatggattcggctctggcggaataccacagggagatgctggagcagtatgatctgttttttatagatatgtcctatggcgggagagccccttccttttccaataccgaagaacatataagaagctatatgaatatgaatttccgcccttttcagatttttaacattccggtggggaaggatttaaccgcgttaacggcacaggatgtacagctgcagcaggcggcggtggcatcggatgaaaagggggcggtattgagggcgcaggctgtcgcttatatgaaggataaatggggactgagcattctggaacaggcggcggagaatgccggactgatccagtccggcggatttttggaaagcgatgtggaggaaagacgcctggaaacggaagagcaggtaaagaatgccatactcaataaagaacagcaggaggatgaggaatgggagggacgggatcaggagctgccttccgacgtggtgaaccaggccagaaatgaagggattctgcgcctggcgatagacaacagctctaccctgtcttccgcatccattcctgtcggtaccctttataccggccgggacagcgttttggaaggcaccggattaatgcagggaatacaaacaccttccggcattgcggatgcctgtatatttttgagatatattatggaaaaatgcggaaattaccgaaacaggaaggagacttcagaaatctcctatcaggtggaatatctgctgcagggcagagacaacgatttggataatctgcgaggaacggccaataaactgcttctgataagggaagccgccaatatggcatatctgtacggcgacagcggaaaacagaatgaagccagagggacagccctgctgatcacggccctgcttggcctgccggagctggaggaggccgtaacacagctgattctgtttgcctgggggtatgcggaaagcgtgaaggatatgaggatgctttttgacggagagaaagtgccggtcataaaggatgggggcagctggaataccccatacagtcagcttctcacctttcgcggccatttatccgaatacccgaagggacagtcaggtcttggctacgaggactatcttcaggctctgctgtttctgatgccgcaggaaaaagtgacaggcaggcttatggatattatggaaacggatatcaggcggacaaaaggaaacagctgtttccgcatagacggatgcatagacggtatgcgggcggaagcggcggtctccagcggttatggctatcaatatacgattacaagaagctatggatatgaatagaaggatgagacagaaaagatgagacagaaaagatgaggttaaaaaaccagcttaagaaataagctgggaaaaggattagaaatgaaaaatcagctgaacaggaggtgagcagggatgccccctttgtacgaacgccatgtaaaaagcaactatcaacaacacaacagaaaggtcatgtacttccgaacgcattttcctcacacaaacgaaaaacttcacacttttacatatcccctcaggcagacggcaaagggggtgtccctgcccgcctcccggcagaaacgttctttgttccgggattatcagggttccatgacggcagaggcgtccctggccgtaccgctctttttattttttatgataaatatcctctctatgaccttgtttttccatacctttgcacagaatcttgaaaccctgcaccagcagggacggcagctgtccatgctggcctatgttacgggagcggaggatgagatgatacagctggtgcggccggcacgggttaagccggtggtccctgttctggcgtatcccggtacaaacattgtaagctgctgctatatgagggcatggacaggctatgatgtggaaagaaaatttagtggtgaggaacaggaggaatatgtttatattacggaaaacggcactgtttaccacagggaaagaaattgtacgcatctgaccctttccattgaactggctggtaaggatgaggtcggacagctgaggaatgaatcgggaggaaaatattatccctgtgaaaaatgcggcggcgacggcagcagctttgtttatgtcaccggggaaggaacccgttatcataataccatcacgtgcagcggacttaaaagaaccgtcatcagcattccgctgtcggaggcgggaggcagaccgccctgttccagatgtggataaaggaaggagaaaaaatggcagaaaatttaatcttatgcagtttcctgggaatctgcagctgttacgatttgaaactcagaaaaataccgggatggcttctgtataccggtatccttctgggaacgctttactgggggattttgaaaatggccggacaggtcagctgggctgcacttccggtgagcttgcttccgggatgtgtgatacttttctacagttatataacagaaggtaagattgggattggcgacggactgctggtcatgccggcagggcttatgcagcaatggcagagatgtacggcggaaattatcggcgcctgtctgctcaccttctttttggcggcgggattactgataagcagaaaaggaaaccgaaatacccgtatcccttttgcaccgttttttctggcagcggtggttttggtgtggataatggaggcctggatcggagttcctgtggataagtgaggaagaaggagctgtatggataaaatgaaaaaaatgtatgatgcctatatgaccctggaagccagtttcattatgccgctggcagtctttctgattgcggcattgatgtatctgtccttctatctgtatacggtatcctttctgaatcaggcggcatatgtatccgccttccggggaagcctgtgcgaaccggacagcggaagaatgaaagcgacagcagagtcggaactggaaaagcttctggaggagagggtgctgccggtaaggaatctggaaaagcaggtgagggcgtccccgctgggagtgaacgtatctctgagagcggagctttcacttccctttccgggtgtacggttatttaccggggcaggctgggagataaaggcggagaaaaaagccctgagcagggatgccgttgcttttatccgcctggcaagaaaggccggcaatttatgattgactgacgcaaaggagcgcagataggagaaaagatgataaagcctgaatataaacgcgagcttagccatagctatctgattctggaaaatataccgaaggacaaaatggacaattatcagtgccggatgatactgaagaataaaattcccggtcttctgtgcagcagtgaaagatttataaacggaaaggtatgcctgtattatgatatcagttcccgccaatccctggatcagctgtatgaggcgggtaagatgtcttttgcggaaatactgggaatagtggacggacttgcccatgtactggaaaatatgtccggttttttgctggaggaacaaaatcttttgctggatccccggtatatgtatctggatttggatacacagcagctgtgcctcctttattatccctttgcggagaaggaaaatccgaccggcagcatttatatgccggtagcggagttttttctggagcatgtggatcataaggaggagaaagcagtgagcgctgcttatcaattctataaaatgtcaaaggcggagagcttcagtatagagagcttccggggtatatgggaaaagaacgaaggtattgggcaggaggatgcaggaccggccggccatgccggagaggcgttttacggagatgacggatatccggagtgggtggcggaaagtgatgaccggcagggacagttttatgaggaaccaggcctgtatacctacagtacagagtatgaaaagcagaagctttctcttattgatatagatgaagataattttacgagagaatatatcgacagaggaatagcagagaaaagaatagcagaaaagagaacggctgagaagaaagagagcgaaaagaaatcggcaaacaagaaagcggcaggtaagagatcagcagataagggagcagaaaaagggacggagaaaaaggcagcgggaagggaaactgcggacgctgcaggaagtgagaaaaacgcggataagctgcgaagatttaatctgacaggccttggatcggccagtctggccttcggaattttgtgtatggttatctggtatctgcagcctgaaaaactagtaaaaacatccctgtttggcctgcttgcgctggacggtgtcgttttgctggtatttttatggagactgacagtaaggaaagaaacgaaagaagaaaaagaagaggagatgcaggatgcagatacatgggagtcctttgaatggctgtcggaatatggagaagacagtaagatggtttttctgggggagcctggatgtaatcagggaaattcaggacagcagaagaaaggaaagcccaggctgaggggagtggtggaaggaaaggaagtcagttatcgactggagccgcttccaatgatagcgggaaagctgagaaaccgggttcagctgcttcttcctgatgcatcggtgagccgtattcatgcaaggcttgtggaaaaagaaggaagggtggcattgatggacttaaattctgcaaatgggacttatatcaacggaatacgtctggaacagaacgagagcatggtgctggaaaaaggggatgaaatccggtttggagatatgatttttcaatatgaggaataatcggaaccggaggtgaaatagtaagcggataactgcacaaaacggcgaacggtttattgacaagtatgtaaggaagtgttacccttttggtattgacaaatattggactaaagggcagtaatgggggttcctatggtaaaaccgcagacttatcggtaccaaaaccagaacatgaaagagattccctggtgcagtgcagtgcttacggctgcaaatgtcattatttttctggtgtgccaatttacaggagactggctttatattaaaggtgaattcggggctttctatttaatccgcagccaggaatactacagattggtgacagctatgtttcttcatgccgatatcagccatctggttaacaatatgatattgctctattttggcggagagattgtggagaaaacaattggcagcgtcagatatcttgtgctcttttttgtctccggtatatgcggaaatctgctgaccgctatttttgaggtttccaccggaatgtattttaattctatcggtgcgagcggcgcggtttttggattgatcgggggccttctttatctggtgataaccagaaaaggatatgcggctcagatatctgtacggaggatgattttaatgatagctttatccctgtattccggttttcagagtgttagggtgaataatgccgctcatctgggcggactgctcagcggttttttgattacatttatattatgccatatcggaaagaatgttggagaaaatcattatcatgtttaaatacaggatgcctttaatgacaggaaggagacagagtcaatgaaagatgaagcatgtattttctgtaaaatagcaaatggggaaatcccttccaagacactttatgaagatgaaaaataccgtgtgatccttgatttgggaccggcagcaagagggcatgccctgattcttcccaaggatcattatgcgaatctttatgaacttccggatgaagcctgcggggaagtgatgatgctggctaaaaaaatggcagtccggatgacagaaaagctgggatgcagcggctttaatctggttcagaataatggtgaatgcgcgggccagactgtaaaccattttcatttgcatctgattccccggtatgaggatgataatcagaatattaactgggttccgggaaaacctgaacaggaagaactggaagaaatccggaagcttatctgcgaagattgagaagtataataaaaggcccgccgccgggatcattctgagtcaggaggtatttcctgtcaggcgatccgctgcgtcgggctgtaaattttcagctgtctattttctcttgttcatatgttcttctgcaattccatccagcaattccgtaatcgtcttggtggcgttcatctgctggctcttacccatggcatcaatataagtctgacggttaaaataaagttcctgtaccttctcaatcagaagatcggggcttaaataatcttcgtcaataaccatgctgaagccctgggcttcaaaagaacgggcattcaggatctggtctccccggctgcttccggcggaaagcgggataagcaggttgggtttctttaaggccagcaattcacagatggcgttggcgccggctctggatactaccacatcagccatggcaaaaacatccttcagttcagatttcaagtattcaaactgggtataaccggactggttcagcagcaggttatcaattttttcctggccgcagagatgtacgacctgaaaatcgttgagcagcttgggaagggcttcccttacggcctgattgatagaagcggcacccaaagagccgccgattaccatgaggaccggtttgttggctgtgaaatggcacaattccagtgcggcaagcttatttcccatggaaagctcctcccggatgggagaaccggtaagtaccgctttttccgtagggaggcaacgcagggtctcggggaaattacagcataccttggtacaaaccgggatacacagcttattggcaagaccgggcgtcatgtcggattcgtggataacacaggggattttcagagaagaagcagctcttactaccggaacagttacaaagcctcccttggaaaagacaatatcgggacagatttccttcaggatcttcctggcttccccataacccttaagtacacggaagggatccgtaaaattctttaaatcaaaatagcgccggaactttccggtggatattccataataggggatgtcataatcctctatcagctttttctccattccattataggaaccaatgtaggaaatttcgtagccgagctgtaacagcctgggcagcagggcaatatttggcgtaatatgaccggcggtgccgccgccggttagaacgatttttttagacatgaacaagccccctaatgaattgtttaatcagcctttcccacaatggattccaaagcgattgccagctgatccgggcaggaagtgggcttgaaaccgcattttattcctttcaggcgggaaatggcatcttctgcagacattccttccaccagtttggagataccctgcaggttgccgttgcagccgcctgtaaatatcaccgatttgattacattgccgtccatttcaatatcaatggaactggaacaggtacccttagttctgtatttcataataaaacctccaataatacttataaattcaatacacgaattatatcaaaaaacatcctttgttaccagtattttcacaattattccatgattatggcagaaaggcacggaattctccgatcgatttgcggcctgtccgtattgtggcggacggttcgatctcctataatactattcacaaaggaaccgtaatggaaccgctgatcatgggacagacgtctcttaagaacagcagattggaggaaaatatgacttcatttatggaaaataaagaactggtggctatgacaattatattgctattattaagcatattatgcaagtttattacaggaatttttttaaattccctgataaaagaggcggaaaatatgtcggccacggaaaacaagatactaaaacagtgtaaaatcaagttcaggaactgttataagctcaatgacggggtgccgaatattcccgtgtttgtggacaagtttatcaaccggattcagataggaaagttttctatggacggtctgtcacattttgcaggacagcttatgatgctgtcggtattcttcgcaggtgcgggggcctgcaagggaatcatagacggaaaaactctcggagagatccttcccttctatttaatgagctttctcggactgtatttatacttcagtgtatccgggatggttgacctgaacggaaaaagggccgcgctgaaaaccagtctgacagattatctggagaaccatatggcggtgaggctttcggtactggatgaaacagagagtctgataaacggagaggtaccggccccgaaagcggagaagggaagaaagcaggcttccgttaatgcggctgaaatcgcggaagtttcagcacctgtaaaaaaggagcgggtaaagggaatacctattcaggagaaaagcctggccgaggagcagcttgaggaacaggtctttacgaaaaaccaggagaaggaactggaggagcttcttaaagaattctttgcatgactttaaagtttcagtttccccctgcctgcaggtttcagtttccccctgcccggtgcattgtgtccgccgccggccggtccgcattccctctgcgaaggaactggggcgagggaaccgcaaaggaactatatcataaaaactcttgaaattaaaaaataactttgctacactaagaacggataaagagccaaattgcagaattttgcgatgaaagccggttatatctattggtttgctgcatatgggcagcagaattggaggaaaacggatgagcaaagtaacttttgattattcaaaagcagcgccttttatcggtgcgcatgaagtagattttatgaaaaaacaagtaatggatgccaaagaccttctggtttccaagaccggtgcgggaaatgatttcctgggatggattgacctgccggtggattatgataaggaagagtttgacaggattaaaaaggcggctgcgaagatccagagcgattccgaagtgcttctggttatcggaatcggaggttcttatctgggagccagagctgcgattgaattcttaagacacagcttctataactgcgtaagcaaagagatcaggaagtctcctgaaatctattttgttggaaattccatcagctccacttatatcagacatctgatcgatgtaatcggcgacagggatttttccattaatatgatttccaaatccggcaccacaactgagccggccattgctttccgtgtatttaaggaaatgatggaaaagaagtacggaaaaaaagaagcggcgggcagaatttacgctaccacagaccgtgcaaagggatctctgaagggactggctacggaagaaggctatgaaagctttgtggttccggacgatgtgggaggacgtttctccgtacttacggctgttggcctgcttcctattgcagtgagcggagcggatatcgacaagctgatggaaggcgctgcagacggacgcaaaaaggctatggaagcagcatttgaggataacgatgctctgaaatatgcggcagtacgcaatatccttcacagaaaaggaaaagaggttgaaatcctggctaattatgagcccagtgtacattatgtatcagagtggtggaagcagctgtacggtgaaagcgaaggaaaggaccaaaagggaattttcccggcaagcgttgatttgacaacggatctgcactctatgggacagttcatccaggacggcgcccgtattatgtttgaaaccgtaatcaatgtggaaacctccagagaggaaatcatcatcaatgaagagcccgttgatctggatggcctgaactatctggcaggaaagaatgtggacttcgtaaataagagtgctatgaacggaacgattctcgctcatacggacggacaggttcccaatctgatgataaatgttcctgaggtaaatgaattttatctgggacagctgttctatttcttcgagtttgcatgtggcgtgagcggatatctgcttggtgtgaatccgtttaaccagcctggtgtggaaagctacaagaaaaatatgtttgcactgctcggcaagccgggttatgaagcgcagagagaagagctgctgaagagactgtaatctggcaggaaatattataaaaagaagctgctgtaaatagaatatatagttaccggaaaagagaaacggaaggattaggccgaagagaggcaaaattcttccgttttctaattggggaaaaccagtcttgtattaaaaagcagtattgtattgctgttatgagataaataagttacaatttggatatatagaattatggtgtacttgaaaattattttcagcagaaggcgcggaattatttttcaggcatactctgatagagaatcagccgtttagggctgtaagggacggaaatgaggtagcagaaatatgattggtatgattcaggatatatcaaccatgcatgatgttttgcatgagtcaaagacgggattatggattattgaaattgaggacggcagacagccccgaatgtttgcggatcagaccatgatggagcttctgggcctgaaggcggtggtgacgcctgaaaaatgttatgaacattggtatgagagaattgcaggagaatattatccggtggtcaatgcctgtgtggaagagatggtgaaaacagggcgtgcggaggtgcagtatccctggtaccatccggatttgggaaaaatctatatacgctgcggcggtgttgccgacaggacctacagtaaggggatgcgtctgaggggctatcatcagaatgtgacggatactacggtcatgcgccgagagaaggaaaagctggaggagctgaatcaggaaattgtgggttctctgtataaccttttcttcgctgtataccggattgatattgagaaaggcactatctgcgccatacgtgtccccggagatgtacaggaaatccctcagggagacttttcctatgagagcttctggaatgattatgccagccagaattttcatcctgattatatagaggaaataagggaagagctttccatagctcattttcaaagtctgatggcggaaggaaatgagagatatgcggtggagagcctccgcaaggtggatggggaatatcattccatatcctgcaacgtctatctgggaggaaagaaaagctgggtgcttctggccctccaggatttgcatgagcagaagaaaaaggatgaagaaagcagaagagcgctgaaagaggcttatgagatggctcaaaaagccaatgaggccaaaagtgattttctttcaaaaatgtcacatgatatcaggactccgctcaatgcggtgcttggaatgacggaattggcacggcttcatatggatgaccgggaaaagctggagaatgctctggataaaatatcttcctccagccagctgctgcttggccttgtgaatgaggttctggatatgagccggattgaaaccggtaattacgagctgcaggacggcaggtttgatcttgataatctgattgaggagctgatatgtctcattatgcctcaggctgaagtgagaaagcagaaaattcatctggaaaagaaggatcttacacacgtcagggtaatcggtgataattccagaatcaatcagatattcatgaatatcatgagcaatgcctgtaagtatacgcccgaaggaggcgatatatatattacggtttccgaactcccttcagggaataaggaagtggggcgttatcagtttgtctttcgggatacggggatcggtatgagcgaggagtttctccagcatatttttgagcctttcagcagggcgaatgattcccggatcagtaaaatcagcggaacgggcctggggatggtgatcacgcagagcctggtgcagatgatggggggagaaattaccgtaaaaagccgtctgggggaaggaagctgttttaccgtgataatagggctgaagcttcagatggatgaggcggaggaggagagccttcctgatatccaggaggtggattgcagcggcgcccatatattgctggtggaggataatgaaatcaaccgggaaattgcggcggagatgctgcagatgacaggggctgtaatagatacggcggagaatgggcaggaggcgttcgagaggtttctggattctcccaccggttattatcagatgattttcatggatatacagatgccggttatgaatggctatgattgtgtgaaggcgatccgaagctctggcagaggggatgcggaaagcgtaccggtaattgccatgactgcgaatgcttttgctgaggatgtgattatgtcggcccaggcaggtatgaatgagcatctggcgaagcctattaagtccagccagctggcggagatcctgcagaagtgggtgctccgcagatcatagtattgtgttagtttggaataggattaagctagatttcccaatagcccttggatataatgaagaaaaaatacagtaatttactcaaacttcgcccatgcccctgtcccctccgtcccgttccttcggggctgctgtccggttcggattcccctccttcccgctgccggccaggcagggatccttgcaggggacactctcgctcggataaacacgcagcggtactaaggccgcaaaggacgcggcctaaggaccggcgagtttatacgccccttacaggaaaccctgcctggccggcagcgggaaggaggggaatccgaaccggacagcagccccgaaggaacgggacggaggggacaggggcatgggcgaagtttgagtaaattaccactaagaagaacaacggagggttacagcatggaacaattagttaagctgcctgtgaggcccgcggcggacagcagaaatatcattcagggagagaattaccgtattacaatgctcacagaggggctggtccgcctggagtacagtgaagacggtatttttgaggatcgggccacacagactgttatcaacagggattttcccgcagtggattatcaggtgaaggaaactccggaggaactggaaatcctgacatggcggttccggcttacctatgataaaaaagaatttaatccccgggggcttcggattcatgtgacggggaataccggttcgggaaatgatgtatggcattacggggatcctgtccatgatctgaaaggtacggccagaaccctggataccattgacggcgcctgtgaactgggttccggtctggtttccagagacggctttacggttctggacgattccgcctcgctgatcctgaccgaggaaggctgggtaagtcccaggaaaaaggggataaaggatatttatttctggggatacggcctggacttcttggaatgtctgaaggatttttattatctttgcggcaagacacccatgcttcccaggtatgctttgggcaactggtggagccgttattatgaatataccgaggaaagctatctggagctgatgcaccgttttgatgaggaagggattccttttaccgttgccgttatcgatatggactggcatctggtgaatatcgatcctaaatatggcaccggctggaccggctatacatggaataaagaatttttcccggatcctaaaaggtttatggatcacctccatgagagaggaatgcgggttacgttgaatgtacatccggcggatggtatccgggctcatgaggaaatgtatgaggctatggccagagagctgggaaaggatatttccagggaagaaccggtttcctttgaaataacgaatcctgcatttctttcggcttatttcaaatatgcccatcatcccaatgaggaaaagggtgtggatttctggtggcttgactggcagcagggcggcatcaccaaaatggaaggattggatcctctgtggatgctgaaccattttcattttctggacagtgcgaggaacggaaaacgcccgatgaccttttcccgctatgcagggcccggctctcacagatatccgataggtttttccggagatacggtggtaacctgggaatcccttagattccagccttattttaccagcacggcctctaatatcggctatggctggtggagccatgatatcggcggacatatgaatggatttaaggatgatgaaatggccggccgctggttccagctcggagtcttttctccgataaacaggctccacagtaccaaaaatgaatttaacggtaaggagccctggcgttacaagcaggagatccgcagcatgatggatgaattcctccgcctgcgccataagctgcttccttatttgtacaccatgaattacagggcccatgcccaggatattcctctgattctgcctatgtattataagaatgccagagcccaggaggcttatcaggtgcccaatgaattttatttcggatcccagctgattgcagcgccgattacctccccccgactgccttctttgaatatggcaaaggagaaggtatggcttccggaaggggtgtatgtggacttcttccgcggagttatttatgaaggcggcaggatgatggatatgtacagggatattgataccctgcctgttttcgctgaagccggttccatcattcccatgacggaagaaattgatgcaaacagtgcggcgggcaatccggcttcctttatcctgaaggcttatgccggtgcggacggaagctttaccatgtatgaggatgacaatgaaacctgtgattatgagaagggtatctgtgtaaccacccggtttgatctgcagtgggagaacgaacagtcctttaccatttatcctgcccggggagagctttccctgattcctgcgcagagagcttataccattgaactgtacggctgtacggaaagtgaagttgattgctgccttgcaggcgcggctatggaagtacagacgagctacgacagaagcaggaactgtctgcgcatcgagcttcctgcggtgtcggtgacggaggagatttccgtaagcttccggaagaaacttaccctggctgaaaataatgtggaaaagctgatctatgatttcctggatcaggcagaaattgcatttgatattaaaacgaggatttataagctggtatgcagcggcagggcgccttatattatcataggagaactgcagtgcatgggtctgtctgaggatcttgtgaaatgcattactgaaattctgacggcaaaatagaagggccggatttggcagaacgctttagagaaagcagagaaagggggtgcgccatacattgaatatcgtggttttggacagaagcagtgtaggtgaagatgtttctgtggagcctctgcggaaatatggaaatgttaccttccatatgactacaagggatgaggaggctgcggagcgggtaaaagatgcggatattattgtggtaaataagacgcctatgaatgcctgtactttggaaggcgcatcccatttgaagttggtttgtgagtttgccacgggttacgataatgtggatttggaatactgtcggaaacgcgggatcccggtggtgaatgtggtaaattattccactgctgcggtagcccagcatacgatagcctgtgttctttacatcctggaaaagctgcggtattatgacgattatgtgaaaacaggcgtttatgcttcccagccccgtttttcccatttcggcctcccttattatgaactggacggcaagacctgggggattgtggggatggggaatataggcagaaaaacagccgccatcgcggccgcctttggatgccgggtgatttatttttccacatcaggaaagagcagctgcggggaatatacacgggtggactttgatacgctgctgaaggaatccgatgtgatcactctgcactgccccttaaatgacagaacaaggaacctgattgaccgggatgcgcttgaaaaaatgaaaaaaacggctgtcctggtgaatgtggctaggggagccgtagtgaatgaggccgacctgtgccgggcgctgcaggaggatcagattatgggcgccgggattgatgtattaagccaggaacccataaatccggataatcctcttctgcagatccgggacagcagccgtctgctgatcacgcctcatatggcatgggccagtgtggaggcgcgtacccgtgtggtgacggagacctgtaaaaatatcgaagcattcctgcggggagaaccgcggaatgtattaaatccttagaaaactcagcggtatgcaccgctgttttttcttttttgcttttcggtccgggcccggcctttggctttcatttgctgattcttcagatagacttccctggaggctgaatatcgcgcctcttttttcagctttaaatagctcttccagcgttcctgggataattccccgttttccagagcggcctttacccgacatccgggttcattttgatggcggcagtcggaaaaacggcattgcgtgaaatactgctccacatcgctgaaggtttcgcccaggccgtcggttacatcccacatccccagttcacgcatgccgggagtgtctataatcatggcgccgcagggcagcatgatgagctgccggtgagtggtggtgtgacggcctttggagtcatcctcccggatgctgttgacagccatcatatcctgaccggccagggcatttacaaggctggatttgcccacgccggaggatcccaggaaaacaattgttttgccaggttccatatagggctgcaggtattccaggccgtaaccggttttggcgctgacggcaatgacatccactgtccgggcaatggcggcggcttcctgaagcttctgcatatagtcctcctccaaatccgcttttgtgaggacgactacgggccgggcgccgctctgccaggccagggtaagatatctctccagccgtcttgggttaaaatcgtggttgagagactgcatgatgaaaacatagtcaaagtttgcggctaccagctgctcccaatggcctgccgaagagggatccaggcgggcaaaaaaggtttttctttttaatgttcttataatccggctgtccccctccggttcccagttgatcaggacaaaatcgccggttgtggggaaggattcttcccctgtataatagctgctctttttcaaagcagccaggcctgtgccatagctgcagattatttcgtatctgtctttataaactgcggttaccctcgcaggggtttctccgtcttgaaacggcttaccatcgggtatatatccatattctgtaatattcaaagtggtttcctccaaaataatgcgatcgatttatagtttccttgtttttattcttgttttcgtttttaatcattataaaatcctccttttcctatttagggcggcatgcttaaaaaagggtataaaaatcccgcagaaacaagccttttcatactgttcctgcgggtcttaattccgtatcaagtatattctgaaagggttgttatcgggtatgcctgtgaagttaagtgaatgccacctcattatttgctttcattaaacaacgctcctttcattttctctccagggagagaacagatttataattagtataagggatgaacataaaatatgcaatactaaattattactcactttttgtttcgaaaccctcatggctcaggatggggattcactgagaaccgcatccagcatatccatcattcggttctggtcggccggctttcccgcggaaaatgccgcgggcatcttctctttcatctgcttcagataggagaaggaaaccggaaaggcccgttccagcccttccagatagctgctgctgaaaaagtctccgctgcctgcggctgaggaaagaatcagctggaagcagttctgaagaaggaagtcccggaaagcggcgctggagggaggggaaaaatgaaacagccggtctgtatagtgaaacagccggtttactacgtcttccctttcctccggtatctgacagcgggagagcagcgtacggctgccgctttcccgatcctgggcgatatcctggagatcatcgcatatctggagcagaaaaccgaagccaaagtagaagagagcatcttgttctgtcattttacagttaatgaagtatcggtctattaatacggataatccgcctttatagatggagatgtccagtatgtttttttcggtcagggaaagggatgcgtccgtctgcttttggctgatttcctgtgcctccagcatcagaaggagtccctgccggatatccgccgcggcttctgcgccataggcttcatcggcttccggcccgggatagtcagcggctatggcgtccaaaagcatggctgttttttcctcatgcagggacaggggggttacaggcaggccgctgattctgtgatggatgagcttgttataatgtatcttttcttcctctgtgtgggacggatcatccagaaaattgtcggtaaaggggtacagcatactgtaaccgaaaatggaggaagaacatttctggggaaggccgttctgctcccggaaaatggcataaaccatgtaattccggatagcctggcccatatcctccagttccatatccggtgcaaagctgcgcaccttgcgcagaaattgttttattttgtcctgaaaagcatccagtgtctgaggggaaagagcatttcggattccaagcaccggttcggtgagaaggaggctgtggaacaggctttccgtttcctttaaccagatttgctgacggggagtgatccgttcacttccttttttattgggaaaagtaaaagcgctgcgggagggaaaggccttcaggtgaagccgtatccgttccgtgctttcggtaatccatttctcgttcgttcctttttccccggcatttatttccgttaggaatggcggaaaggtacattcggctgactgccacagctcctgaatccggggcatgagggagccggttatatattctttctgaaatagcatgggattctcctgtaattttaaatcggtatcatcagttcgtggagcatcaccaatattatgaagggaaagcaatgaaattacaagcaaattatggttgcggcggaataaatctccctctttcacttttacgaatagaatgatacaataatatatcattaacatacagttaggggaaaggggttacacaatggacagagtcagtctgactaatacggatctgcaggtttcgcagctatgtctgggtaccgcggatttcggcacaaaaaagagccgggaggaagctttccggcagatggatatctttctggacggcggggggaattttatcgatactgcccacgtttacggcgattgggcctgtgatgaaagaggacgcagtgaaaaggtcattggggaatggcttaagggaaaaagggatcaggtgatcctttcaagcaaaggctgtcatcctcccattgataatatgctgtgctcacgggtagatcccgggaatcttcataaagatgtggaagaaagtctgagccagctgcagacagattacgtggatctgtacttcctgcacagggataatccgcaggtgccggcaggagagctgctggaagcccttgaggaagaggtccgcagagggcgcctgcgttattacggctgctccaactggagcctggatcgtctgaaggaagcggatgcttacgccagagagcatgggctgcatggatttgcctgtaaccagatgatgtttgtcctggccgatgtggttccggaaacattagtggaaccgcagctcaccatcctggatgatgcgtattaccagtatgaaaaacaaaccggcctgagctttatggcctatatgtgtttggccggaggctatttctccaaaagaatggcaggtaagccggtttccccccagcaaaaggagcggtaccacggggaagcaaatgaggccatattaaggcagctcaagctgtgtgtgagcgagggctacaaggttacggattttctgtacagctatgtgaagcgggcggcgttcccttccattccgatttccggattcggaaatgaggagcagctgaagcaggcgcttgtgagcatcgagcaggaggttccggatgaaatgatgcatgatctggtgtccttaaaaagaatgcagtcctatcattggtaggcttttttacaaccggcagttgatttctgccggtttttctattgtgccgttattttctccggagataaggaatgatacaatgaagcggtaaagaggccggcaagttgtatacaggaggaatttaaaatggagatcaggttatgtgataatattgtacgattccgtaaatcaaagggctatacccaggaagaactggctaagaagctgaacatttcttcccaggcggtatccaaatgggaaaatgcccagtcccttcccgatatcgccctgcttcctgcgctggcaggaatactggaaacggatatcgatacgctgatgggatatatccccaaaaagaaaatggtgacgccctatgaggatcgctataatgcgaaggaatattactggggaaccatgccgaatgaaatgtgtatggaagtgcttcgcaggtactatcccacaaggccgctccggcttctggaggtgggctgcggagaaggaaaggacgctgtatttttcgccagaaatggctatcaggtcacggcctttgatgtgacggaatccggaattgaaaaagccagaaggctggcggatatccatcaggcggatattgatttcttccgtgcggatttgcgtgacttccgactggatgaggatttcgacattatctacagctccggggtattccatcatatcctgccggagctgcgggatgagattatggaaaattaccggtcgcatacagctcccggcggcatgcacgcggtcaatgtttttgtggaaaagccctttatcccggagccgccggactcggacctgtgttcccggaactgggcatcgggagaattgttcacctgctataaggattggttgattgaggagtgcagggaagtgatttttgactgtaacagcagcgggattcctcacaagcattgcatggataccgtatttgcaaggaaaatgccggatagaaagggagaataggagtgagatggaagcaagaatgacagaagaaaaaaacagagagacagcaccggtacaactggaaacagcgcgtatgattctgcgggatcatcgtcaggaggatttcgaaagccatcatgctttgctctccgatccggaggtgatgtattatcttccggatattatgactcacagcagagaagaatccctgaaggatcttatgatctctgtggaagcaattgatgcacagccgcggaaggaatattttctgcgtatggaggataaggaaacaggagaactcatgggggaaatcggttatacggttttggaagaaactcctgtgggcaagctggtacacgccggatatttcagcagaaaaaagttctggggaaaagggtatatgacggaggcattcagggaagttctgcgttttgcctttgaggaaaacggagtatgcagggtgacaacagggtgcgacccggagaataagggttcggaaaatgtcatgattaagtgcggcatgatcaaagaagcgaatatgaagaaaaaagtatggatgcatggtcggctgcgggatcgggtggagtaccggcttttaaaggaggaatgggagaacgggaaggaacaaaagtaaaagggctgtctttccagaagaatagagttctgttatactgtaaccaggctgtgatttcagatatcatcgggaacgcctgtttttaaggacgaaaatcggccgccattttatggcggcctttttggtactggatgttgggacagcctttagatgcgggccttcagattctgaatcctgaataaggggctataggctgcaaaggggggatagctatttctgttttaaaattagtaaagaaatcttttttctacagggtaataagagcctttttagtggttctggtacttgtgtatttattgtatttcgggatctatatggctggctataatatgctgaccgatgaaatttcccagtcattatattccaaaacctcttatctcaccaatactctggaagaggaaatcagaagaattcagaagctgcagtttgaatgtattaatgacgatattattttttataccatcagtgcatttcccatcctgaccaaaagcgagcaggtgaaaaagcttttggaaatgcagaatcgactgaaaattctgcatgaaagctccacctatatagatgaggtgtttgtctgtatcccggggatgaaccggaaaatttcttcggtgggcggagtggaattagtgggagaaaagaatcaggaatttcagaatatgcaggaaaaatctttgttctcccctattttttatgatcagggttccatgtacctgggggctgcctatcccaataatatagtgaatatggatacctcccaaatgtttacgctggtgatccggctgtctgaaaaggaactgaaaaaagaacttaatttcctgggggaatatccggacagcgggataaagctggtggactgcggaggaaaatatgaactgaatgtgggcagggatatcaatctggaaggaatcaacagcacgaaggagcagtggctgcagcaggttacggatgaaaaagatcatcagaagtatacggtatttaaaataaattccgcttttctgaacatggatttatttgcctatgtttccaatcagacggtatacaggaatctgcagatttaccggaatattttctttatttgtctgttgatggtaatgctgatgatggcagtctatatctattctcttcatgttgttatcagccatccgattaaaattctggtgaaaaccatagaacggatggaaacagggaatctgggagtgcggattacggagaagcgggaggatgagtttggatatgtgtacatagcctttaaccggatggcggaatctctgcagaaccagatggagatcaattataaacagaagctgctgacacagcaggcagagctgagacatctgcagtcgcagatcaatccgcattttctttataacagtttctttacgctctatcggatggccaaggatgaagactgtgagggtattgtggaattttcttcctatttatccgaatattatcgatatataacaaagagcgccaggagtgatacggaattgaaaacagaggtggagcatgcaaggcgttacgcccagatccaggcgatgcgttttaaacggcggcttaccgtggaatttgaaaaattgccggaagagtttgaaaagattaccgttccccggctgattgtgcatccccttttggaaaatgcctttgaacatggactgaataatgtggagaagggcggcgtcctgcgggtctggtatgagcgaaaggaagaaaagctttatattcatgtacaggataacggcgtgggaatgacagctgcggagctggagactttaaaagaaagcttccggcagacggaggaaaccatagagaatggcatctgtaatattgaccggagactgaagattaaattcggtgaggaatatggaatagaaatcagcgcggaagaaggaaggggaaccgtctgcagtctggttctgcctgcagacagcgatgagaaggggggagagtatgtatagggtattagtggtggatgacgaagaaatgattacggacagccttgccggtatgctggaggaaacacctcagtatgagctggatgtttataaggcatattccgggacagaggcattgcggcttctgaatgagttccagttcgatatcgttgtatcggatatttgtatgccgggaatcacaggaattgaactggcaaaaaatatccggcagaaatggcctttgtgccatgttattttccagacgggttatgatgattttcattatgcccagcaggcaatccggcaaagggtgactcattatattttaaaaagtgaaggggatgagttcctgttggaggcgataggggaatgtatccgaaccattgaacgggatatggatatgcaggataccctgctgaagacaaaggaggaaactcgtctttataaggccatgcttcgtcggaatatggtgcagacgctgctttttgatcagagtaagcggacgagccacagggacagggcgtatgaaaaggtggaaatagatttgaatttaagcctccctgttatgctgctggcggggcgcagcgcacaggagcttacggaagagacggctcttgctattgacctggccatgcaggagaagatttcctatgccgtaaaaagtgaagccgcatggatggacaagcatgtgattatgtgggctttgcagccggtggaaacagagaatctccggcatgcccaggcggtggtaaaaggaatggcagaggggattcagcgtacgatccggcagatgctcggtatttccatttctttcgtgttccgggagaaacagattgactgggaacatgtttcgcagccgtttgaggaactgaagcatattgcggccaaccgcctgcgggcggattcccagatcgcaatggcgggtattgaatattttgaggaggagggaggagccgccggcgggcagaatgaggcggaactggaaaagtcctttgtaagccggctgatggcttatatgacggagcatatagacggggatctgtccctgtgtacgttatcggaaaagctgcacctgaacccctcttatttgtcgcgccggtttaaggagcttaccggcaggacactgacggaagtaatcctgcggatccggatggaaaccgcatgtgagctgttaaaaaccacatcataccggatcagcgaaatcgcccagatggtgggatatgaaacggcggcgaatttttccaaagtatttaaaaaggctatgaaaatgacacccagggaatacagagacggagaaggaacaatgcagtagaaggatgagaatcacaaatggggattcctctccggccgttccatctgctgttcccggccattttgataagggtctgtttcaaacagttttgtctatgctctccactgccgaagcggctggatgtcgttgacgtcaaagcggctttagccacttaaaccgccgctgcgggcggtcagtggaaaatagaaacaaaacagggagaagcaggcccttttttgagatagcagtgaacaaagtataaatatgacggatggttccttttatttgtttgccaaacataaataaagaacaaggtaaaaaaagaacaagaaagataaagaatgcaatatatacaaacaaaaaggcaaaaactataattaaatatataaagtatataaaaggagggcttgatgtgaggaaaaagtttaaactggttgctttgacaactgcaatggtgatgacggcagcggcagtaataggctgtggatcgcagtcgggggacggcggcacagcggcgccggaagaaaagaatacggaaaataatgtggaaagcggctcggaagcggcgggagaagtggatgtgttcgcacgttatgatgagccggtggaaatcagttcggtaaagaatctgggggcgggcatgcagtttccggaaggggattccctggaggataatgtctggacccgctattatgaagaggcgcttaatattaaggtgaactgggtatggtccacgaatacggagcaatatgcgcagaaggtaaatattgccataacctcggatgatatcccggatgttatgcaggtcaatgcgtctcagcttaagatgatgtatgacaacgggcagattatggatgtgactgaggtggcagaagcaaatcttgccccgtttacgaaggaggtattgaattctgacggagggcttgcgatgcaggcggcaacttttgacggaaggctgtatgccattcccaagatcggttctccgctgatgaccgcaaaggtcctttgggtacgtaccgactggctggataatctggggctggagctgcctgagacggtagaggacatgagaaatatcgctgaagcgttcacaactcaggatccggacggcaacggtgttgatgatacatatggactggcggtttataaggatctttatggcagcggttatgcggatttgactggctttttcaatgcttataatgcctatcccgggatttgggtagacaagggggatgaggttgtatggggcggcattcagcctgaagtaaaggatgctatggcagctctgcatgaaatgtatgcggcaggccagattgatccggaattcggtgtaaaggatgccaataaggtcaatgaagatgtcagcgccggacgctgcggcatgatgttcggtgatttctggaatatggcgtggatcaatgatgcgaagataaaggatcctgcgtttgaatgggttccggtggctattccttccctggatggcacaacacccgcaaaggctcagctttctgcaagcacagtagatttttatgttatcagtgcggactgcgaacatccggaagcggttatcaaaatgctcaatttacagcttgaaaagagttatggtgaaacagcggagcctgaggtatacaatatcacaccggaagggtttggcacatatcagtatcctgttgtatccatcgagcctcctatgaagaatttcaccgcggcgcagaaggtaacggcagttatcaacggcgaagcggatcccgataccctgaatgatgaagagagagggtattacgagatggcatgtaagagcctggatggcgatcataaggacaataactggcatcagctgaaaatgtatgggcctggcggagcgctcggcgttatctatgacaattactgggttcccggcaatgtggttaatgatgcgtactatgcggcccccacagaggccatggcggaaatgcttcccactttgaagaaacagcagctgcaggattataccaatattattctggaaggggatctggataaatttgattccttcgtggcgaactggaatcagctcggaggggaagaaatcacacaggaagtgaatgactggcatgcagaacagaattaaggaatgaaaagaagcggaggagattttctcctccgtctttgataaggggtgatgtcatgaaaaagtccagaaagacaaaaaagttttttaaaaacggctctctgcatcttatgatgatgccggcgctgattttgctgctgatttataactatattcccctggccgggaatattatggcctttcagaaatttaatcccagcaaaggcttcttccattctaaatgggtgggacttaaaaattttcagtatgtgtttcatctgccggatatttaccaggttatatggaataccttttacatcgcaattctgaaaattatcatgggtatagtgattcctgttattgtggctttgcttttgaatgaaatccggaagatgaaatttaagaggaccattcagaccatgatttatttcccccattttttgagctgggttatactggcgggagtttttgtggatgtattgtccccgtcaaacggggttatcggcaaagcatttacagcgatggggctggaaccgattttctttttgggggattccaaatggtttccctatacgatggttctgactgatacctggaaggagtttggctacggaacaatcgtgtatctggcggcgttgacagggatcgatcccagcctgtatgaggcggccgtgatggatggtgcaaaccgttggaagcaaactctgcatgtgacgctgcccggtattttgcccattgtgatgctgatgtccattctggctatgggaaatattttcaatgcggggtttgaccagattttcaatatgtacagtccgcaggtttacagtacaggcgatattctggatacgcttgtataccgaataggcatgctggatgctcaatatggagtggcaacggccataggcctgtttaaatcggtgatttcctttgccatgcttggcatttcttatatggtggcttataaatataccgattatcgtgtgttctaggaggtggcattatgcgcagaaaaacacttggaatgaagatatttaccgtttttaattatgcatttctgacgctgcttgcaatcagctgcctcttaccgatgctcaatcagctggcgatttccttcagctccagcagcgcggtggcagcgggggaggtggggctccttccggtggatttcacgctggattcctacaaatatatggcggataaaccggaattctggaaatccctgagcgtttccctgggaaggattttgctggcggttcccatcagtatgatcgtctgtgtgctggcggcatttccgctgtcccggctggatcatgaattcccggcaagaaaatattacatctgggtattcgtagtccctatgctcatcggcggcggcctgatccctacctatatggtagtccgcaataccggtctgatcgattccatatggtcccttgtattgcctaacgcagtcaatgtattcaacacgattctgctgatgaatttcttccgttccctgcccaaggagctggaagaggcggcttatgtggacggagccacgaacttcagggtgcttcggatgattattcttcccgtatccaagcccgtattggcaaccgtaacgctgttcgtcatcgtaaatcactggaattcctggtttgacggtttgatttacctgaattctccgatgaaatatccgctccagacttatctgcagacacaggtggtttccacgaacctgatggctttggaaacgctgcgggatgtacggcagatcggtttgatttcggatcggaccggaaaagcggcgcagatctttcttgcagcggttcctgttttgatgatttatcctttcctgcaaaaatattttacaaccggtattgtaatgggcagcgttaaaggataacgctgcctgacacgaagaactaggaggaacgatatattatgtggactttggattcacccaataaagaattgaaggtcatgatagagcagcagggggatggttctctgcggtactgtgtcagtaaacatggaaaaaaggttattgaggaaagttccatggggatttgcacggatttgggagattttacggaaggtctgctctttgaaaaagaagagagagattccattcaggaagaatattccattcctgtggggaaaaaagaggtgtatacgaatcacgcgcaggaattggcactgtgtttcagagcccatgaatcggaatttacggtaaggctgcgtgctttcgatgacggaatggcttttcgctatgagatccgtacttccggaaaggactcttttctggtgaaaagggaaaatacggaattcagaatttcaaaaaattgtgataagctttggcttcaggactggattccaacctatgaaggcccctataatgcgcggaattgggataagagtataaacgggcagccttttggcatgccgtccctgtttttttcggaaacggacggggagtggattatgctcaatgaggcaaatgtgattaatacaaacggcagctattgttcctgccatctggttggaaatgaaaacagatgtatgtccgtgggatttgcgccggaagaaaaaggaaagcctgttaagacgcgcctccctttccaatcgccctggagatacgcagtggccgcggataatctggacgaactggtaaattccacgataaattataatctgaatccgccttctgtgattgaggatacctcctggattaagcccgggcgtgctctctggtcgtggtgggaggatatgaatggggcccagctatacctggaatccagaaattatgtggatatggcggcggcatatggctttgaagggctgaccctggactgcggctgggatgcctgctgggtgaaggacctttgtgagtatgcccatgaaaaaaatgtgcagatctggatttggactgccatgcagcggctggataccagggaaaaggctgaggaactgatccctttgtgggcaagctggggtgtggatgggttaaagattgactttttcgagaatgattcccagcataccatgtggcagtacaatatgcttgcggacctgatgattcagtataagctgatgattaacttccatggttccgtgaagcccatgggtgaggggaggacctggccgaacttcatgacggcggaaggcattatgggtatggaacactaccagtggagtgatctgccgaattcccttcataactgtaccgttccctttacaagaaatgtggcgggccctatggactatacacccacggcattttccaatctgaaaaacaggaataccaccatggggcaccagctggcgctgccggtggttttcgattccggcctgactaactatgctcttgccctgcgttttatggaaggatggaaggggacggattttctgcgccgcaccaaaaaccattatcagggtgtgaaggtactgtccggttatccgggtgatcatgcggcaattctgcgttatacggatacggaatggctgataggtgtgatcacatcgcccaaaaaggtggtgaacctttctcttgattttctgggtgagggtgaatatgaagcggagatttatgaagacagcgccaagggcgaaatgatttccaggacctgcagaaaggtaagggcagaggatgtgctggaactgagccttcttgcgaacggaggcgccggagtttatataacgaggaagctggagcccttatccttcggtatctgttccggatatatgagcgatcgctatacggagtatccgggaaaagacgcgaagatgctccagggcagtgaaaaggtggagtgggatgaagagactgccggttttgtattaaatggagccgccgagttttacggtaaggcggaggagactaaaaattattctcttcgtctgttctatgcggcagaagaaccctgggtcatggaatttacctgcggcaattttacggctacggtgaaaatgcctgcgagcactgcgatccgcacctttataacacatgagatcatcattcccgttaatgcgggggactttactttccggatgaagcggatctccggtaaagcgccggccgtatggaagctgaagctgattgataatgatccgtttatacccattgcctatggaatcagggaagaaaatctctgcggaggaggggaaatcacctgcgtggacggcactgcagtggcgaccggactcggctgggatgcggaattgaggttcaatgaggttatggtgcctgcggcaggaagatatatccttcggatcatctatgcagcaggggactgcagggatatttccattcaggcgaatgacggtgaagtgattaatacttatctgcacagtaccagcggctgggaattccccacatgggagtatgtgggagaaaaggaagtgctgatcgacctgcaggagggtaaaaaccggatccggatgttcaacgatcatggcctgatttcccatatccgggggatagaactgatagcaaaataaaaaatgtcgtaataacaagtgttttgtcgggttgtttaaaaaagataacaatatatagtgcgggcggtcttgcattttccggttttctttgataccattagtacggaatgctccagtgatgacaggacagacgaccatcactataataaaaattcggctggtaaatggaaggtgaaaactgcaaattttaggaggaactaataatgagtagcgaaatcagagacattaacctggccggatccggcgagcagaaaatcgagtgggtaaagagaaactgtgacctgcttcgtatgctggaagaagaattcagtcagacaaaacccttcgcaggcaagaaggtgaccctttccgtgcatctggaagccaagaccgcatatctgtgcaaggtgctggcggcaggcggtgcagaaatgtacgtgacgggctccaacccgctttccacacaggacgatgtggcggctgcgctggtaaaggccggactggaggtccatgcctggtacggagcgacggaagaagaatacaattcacatatccgtgcggtgctggcagcaggccccaacattattattgatgacggcggcgacctggtacacatggtgcatacggaaatgcaggagctgattcctgccatcctgggcggctgtgaggaaacaaccacaggtattatccgtctggaagccatgaacaaggcaggggatctgaaattccccatgatccgtgtgaacaatgcacagtgcaagcacttttttgataacagatacggtacgggacagtcggtgtgggacggcgtgatgcgcaccaccaacctgattgtggcaggcaagaacgtggtagtagccggatacggctggtgcggcaaaggtgttgccatgagggcaaagggcctgggcgctaaggtaatcgtgacggaaatcaacccggtgagggcgattgaagcggttatggacggttttgaggtaatgcccatgaaggaagcggctaagaccggagacttcttcgtgacggtgaccggatgtgataaagtaattgatgccgaggattttgcggtgatgaaagaaggggccattctctgcaacgcagggcattttgactgcgaaatcgatatggcgggccttcgtgaaatagctgtggaatccagggaaatgcgcaaaaatattatgggttacaagcttcccaccggacagtggatttttgtcctggctgaagggcgtcttgtaaacctggcggcaggcgacggacatcctgcagaaatcatggatatgagctttgcaatccaggctctttctgcgaaatatctggtagagcatggaaaagagatgaccgaaatgctgattgacgtgccggtggaaattgatgaggatgtggcggcaagaaagcttcgttttatggggaaggaaatcgataccctgactgcggagcaggaggcttatctgaataagtcactggtatagaaggcaagacgaatagtaatagcggaaaattccggcaccccggcagcagaaggtaactgccggggtgtttcttataccgttccggcatatattcagtttttttggatgaaaggctgaaattttgtctccttcagggcatttctcgttttttccggggtaacaggttttaccatataatcgaatacccggcagttcagtgcgtccattgcgtaggcagctgtggcagagataaatacggtcagtgcgccgggattgcatttttccgtgatctctttcagtctgaagcccgacattccggtcattgcgatttccgtaaacagtacgtcaacgggatgactgcgtacataacctgccgctgccagaggattgcagaacataacgattttgcagcccggatatgaggacttcaggaattttaccaattgcttcaaatcttttttattgggatcgactgctgcaaacagcatgtagtttctcctttccgtacaataaacagggggttaaattctctataaactgtattggtttcttccggcagctttggcacggtagagagcctcgtcggcctgatggtacaggctttcaaattcagcatcctcacatttagccaatgcgatgccgatgcttgccgtaatgctgcaggcccccgattctaatgtgatgttctccgcaagggcagcgtttatttttcttgccttttcacagatccatacttcgtccggaacccatataaatactgcaaattcatcgccccctatacgcccgacgatgtccccatcgcggaattgtttccttaggtttcctgcaaatatcagaatgacagaatctcctgcggcatgtcccagggtatcattgatttttttgaagtaatcgatatcaatcatgagaaatgcggcaaggctgtcaggatttcctgtgcgaagagcgccggcaacctgtttttgggtggcggatttattgtaaagtccggtaagggggtctttctgtaccttttctattagctcctgcttctgttcttccagcagagcggctttcgtactgtcggcaataatccctttgaccgattttgccatatgccagaactgcagaattagaaaaataaaaaaaccgagcttgaaccagaacagggaagtcttgttttccctgtgttctccgaaaatctgtaaaaacatccctgccacgagagcgagtgaatcaatgagagaatggtttattttgtcggaaaaccgtatgttttcataaagtatcatagctggtatggatattccttccagtatggtaaaaacgattataacgtttaaaaaatcataataatcataaatacccatcagctgcgcagcggttgcagccggcagcagaataaattccagcgccgcttctgcggcaaggaggattttccagcgtgtgtgcagcaggagtataaaataggacacaaggaatacgctggttataatcatacagacaatatccaggctgttattgaataccggaaggggaatcaggtaacattgcacattgaaatcaataaaaaaccaaagcccggcagacagggacagcccggcaaagcaaaaagtctgccggaccacttttttcagcggataaagaagtatacaataaacaattgcaatgattcccagacagaaaataaagacagccagcagaagatccattgcttttgaccggataagggaggtgatgagttcgccctcataaccatagtacatgaattgaaagaataccgaaaaagcggtatccgaatggtttgtatagagattctcaagctcaatgcggacataatcgtcagatgatatgccgggagagatcaggctgtcccatccattcccggcagatctggcgtagtgagggaaggtgcccttttccccaaaggaatatatctttttatctgctgcataaatagttaccttcagattatcaatgcgaagcatgagctgccggccggcagggatgtcttcgctgaaggttcctgttaccgttacatgatgccggtcatggctcagcccgtcaatcgaaccgttaaaagggagcagctttccattgttatccacctcataggttcccaggaaggtgatttgctgcagctccgtctcgctatggaaacggctttcatctgtccgtatataaacaagcgcgccgatgcacagtaaagtaatcagcagtgctgaagaagcaagacattttattagtttcccgctcatgatttcgcctttttcttttccgttttgttttcatacatgatactgtcagcacgtttaaatacatccccaaaggtcaggtcggtttcctgcgtatagacagcagcgcctccggctatggaaagtacagttcctttttccgagtgtttgttataaacggacagctctgattcaagctgtgccatcagatcacggcaaagttcggttccgacatcttccagaatgaccacaaactcatcgccgccgatgcggtaaacgggatatttccggaatactttgctgatgagtttgctgctgtcaataatcaccatatccccaaattcatgtcccagagcatcattgactgccttcagattgttcacatcaaaaaccgccagtgcaaattcgggttttttcaatcggatcatttcatccatctttgttccggcttccagataagcggtgcggtttttaaccccggtcagtaaatcccgataggccagattgttgatataatcaatatagtgtttcagatgagctacagtctggcggaagctttcagacagagtaccaatttcgtcatgagagtggcaggtcagcagcacgtccaaatcgccatttgcgattttctgcgcggcggtattcaattctataagcggtttcaccagctttcgtgttacacaaatactgatgcagacggccacagccaggatgaacagcatttggataatgacttgtttaatgagctgatttaggttttcttcaatttctgatacgggggcggtgagtacgaatttcattccgtttacaagacttagaaaagatgcatttttaggtactccgttatatatataggaatacagagtatcaccgctgctctcctgttcctgcttcagcaatcctgcaaaatcctgaaattcaccattgttgtaggtttccaaatcggttccgtttgaaatgtctttgtggtataccacctttgcggtatcgctggtcaaaaaagcatacccggtccggtatacggtggtttcactgacaatctcctgcagatattcaaaatttatatccagccctaccacacctaaaaaataaccatccttatagatgggaatcacataagatatcatttgcaccccaatatttttgttaaaataaggatccatccaaatgccttttccgttctcctttgcgtgataaaaccatcctacatgctccgtatcggttttgtcataaacagacagatcggtaggtatctgtttttcaaaattgctgccgcctcgttcccggctgtaaaaaaaaccggactgggaatccgtaagctccggactgaaccgaagatacacggcgacagcaccctgcgtattttctgcggtactgacagcagggcctaccagcttatcactgaatgcttttgcataggatgtatcttcctgcagtttttccacaccctcaaactcagcgagtgcatagtttttcagcgtttctgtggacagcataatttcggacaatatacggtttaatttctcagcccttactgtgcagagcagattcatggcctgagcagcatctgccgtcactacatgatatgttttgataattccggtacctccgattgccgccgacgaaagcagcagacacagaagcaccagtgtcattacctttgtttttatagatttcacaggattccctcctttaacggtatgattatttctgccttcgtccccacgcccggtatgcttataatggcgagcgacgcatggcattggctttccagcctctgccttacatttgtgataccaatgtgggtgtgtccgtccgctttggtttccgccgtatcaaacccgcatccgtcatcgattatggtaatgattacggcatccgatgtcagcttgctctgaatccatatggtgcctccctcttcctgttcggtgatgccgtaacgaaccgcattttccaccaggggctggagtgtgagcggcggaaggaagaaatcgtcaaatgtaatgtcccattcaatattcaaacgctcttcaaacctcattttttccaggtagagatagtcttgcacatggtttatttctttgctgaagggaatcagcctgatatcggaaagagaatccaggttccctcttagaaaataggaaaaatggactaaagcatcggaagctttccggggctccgtatcgcagagctgtttgattcccagcagtgaattatataaaaaatgcggctgaatctgactgagcatgacggcgatacgcccctgtgtcagttcccgttccttttcccggcgcttgttggcttcctcctcctggattcccaaatagatacacagtatggttatggtagtggaaaggtacagcaatgcaatgccatagacgaagatctggatcagcattgccagaagcggcagtgcaatatagactgtaaaaacaagaatatccttatcggaaagctttttccggtggtggaataagagtcccgcattaaggacaatgcagaaaatcccccacatctgagacagccagaaaagtccctgcctgtgataaacattatttttatcaatcaggtagtacatatgattgaactgggatataatcaccagcaggacggcggtaagggccagtccccgcataaggataaccggttttcttgaaacaggccctttggcagcaatgtaattcaccagataatcggtaaacgcggccaatagaaaatatcctaatacatagaccaggaaattagcagtatgtacgccataccaggcggcggttccgggtctgcccttaagcccccacgctgctgcatcgctgcccagaaggagagtgttcatgattaaaaccttcagaaaacagctgttgagagcatccttttctatgcggtaaagcagcagggaaagaatgagtatgagagacagaaaaacaccgaacagctccagcgatatattgatgcagcgtatggtactcatgagattctcctttttcatccgtacaatatttctggttggaggcgggggccctgattagctgccgcctgcctgcttgtaatagtagaatacaaagcatgacaatacactgacaaattcctgattttatcggcaaaagcaaaaaaataccggcagcatgaaaatgctgccggaatcgcgcttccctttccgttatttattcataaattgttttccgttccagttctcccagggtgagttccgcccagctgtaattcgccatgtactgtccgcagtaggaattgaccgccatcatatccatttccagaaaacggtaataatcacagtcaactttggccgtatcgatcgctatgcggttgcggcttttgattacaatatcctgcacacccgcatccttgagaaccttcatcatatcagagagcaccttctgtgtgttgttctgcagagcccggtcatagggcctgtcctcccataaaacagcagatatttcagcgatagtggcggtagcccctttcctgtcaataaggtaggcaaggcactccttactctttgtacggggccattttaccggctgcccgtccacaaagaattcaaaatttccaaaggtctgtacccggacacgggattctccggatggatgacagggtggatttctcaaattatctaattcataccgtaaatcttccatacgaatcggtttcatgatatagccgctggcgtggagcttcagagcatccatggcatattcggaatagccggtggcaaaaataatattgagtgcagggcagagatccttgcatttcctggcaagggcaatcccattcagccccgccattttaatatccaatacggcgatatcaacatgatgctctgaaagataggcaaaagccgccgcggatttcaggaatccattaacttccgcgtcaggcgctgcttttttaagaagtgccactgcattgtccaacgcaagacgttcgtcatcgactgcgataatattcattcgggaacctcctttacctgcagtatgatacttacttttgtaccggtttccggccggctttccagctgaagcgtgccgccgcactgattttccagccgccagcgtacattattcagaccgatgtggatgcatccgtccgttccggactggttttctgagaaacccatgccgtcatccgttacggtgatacgcacccattccgatgttctgctgctgtgaattctcagcgtaccgccatcctcacgctcggtgatgccataacgtacggcattttctacaataggctggagcgtgagaggaggcagcagaaaatcagagaaggtgatgtcccattcgatattcagccgttcctcaaatctcattttttccagataaagataatccctgacatggctcaattccttttcaaagggaatgagccgggtgtccgacagtgagttcaggctgcctcttaaaaagtaagaaaaatgttccagggcaacggaagctttccggggctgagtatcacagagctgcttgatgctcagcagagaattatataaaaaatggggctgtatttggctgagcatgatggatatgcggttctgtgtaagttcattttctaatttctgggttttcagccccatgagaatagcggaacggatatagcggatagcatggatgagctgcgcggccataaggaggataaatccggggaacagcagcctgccgggcggaaaccattcaaaagcatagttgagaaattcccaaagggcggtgaacagaaacagcaggcccggcaccattaaaaaacggaaatcatgtttcctgcacagaaactcctcatataaaatttcccctgtttcggccagagccgccagcccaagcacgatgaccatggcggtgcgtacctcatagccgtctgtaaatcccataagctgcaatatcagaaatccaacgataaacagtaaaagaaaagcagtagttatattgttgacgcgtttggcttttgtctgcataaaggagcccagataagctgccagaaacactccggacgagagaatacacaaaggttcaagctgcatgataagtgctgtgttttcgaatagcagggtgctgtactccggactcagcaggatccaaaagcagctggtcatggcaaagccggagaaaaggtaaacggatgggtgaatggctatcccctgtaccgacagcgcaagcgcgaacaggaaaagcagtatgcttaaaaagaaaaatacaagtccgcctatgatataaaaccagtatttctgcatgatggaccgtgccagggctccgctgtccccggtttgcaggctgtccatgaaatcccggtaggcactgtaataattgttctgatatttgctggagagctcaatcgtccattcgtcggctgaggaaacatcttcgggaatgaccagactgccccatgacattccggaggaacggacgagagaagaacgggattcttctgttccgaaagaaaagagaggtgtgccgttcagtgaaatatgcacttccatgtattccataagaaaaaagagatgttccccttttaacagcgggcggttaaaatatccctgcatgactatgcctttactctgaaaggcgctgacaagcttgttatctgcgggatgagatgtttctgacccatcggtatggtatgtccccacaaaaccgaggggagcaatttcggtcttgcactgactgccgtatgggatcagccgcacgatgataatgcctgacagaatgacggcagcaaggatgagcagaagcagaaggcgctgtttcaaagataagtttacttgtattttcttcatacgtctgagttctccatgaggacaggtatgtaaatcagggtgtcagaactgtcaaagctctccggcatgctgaagatatgagtttcggagtgaaacttattataccatactcattcggaaatctatagaacttctgtctgtataaaaatggtatcttttcagatacgattggaagccctggcttgaaattacacagccagggcttccagataagcgatacaaataattggaattagcataagtaaaacagttttgcctgaatgtcccccgtcacacctattttttcgtagggctgcagcgggaaaacactgactgtaaatggagtcagaccgttgtctgcgagaacttccagaatacatttatcaaatatgatttctatttcggaagaatcacggagctgtctcggggcacggttcaggccgtaggattctttttcgtaatcctgctggaaagaggactgcccggcatgcctgcggtcgacggttatttcttcttctgtgactgtgatttccacaaattcacctgaactgttccggaatacaatttttccggtgccgttcacggctgctttcagcccgaaggaatccgagtgcagccggttatcaccctgtgtcagagggaacgatacggcctccagggcctccgttcctttaaaggaaaaggaaaggcggtatccctgttcagtcttaacaagcttcatttctcttgcgagagtcattttgccccggaagccggattcggcggtaggggcctgcgcggcataatcccagttgtccgcccagccgatcatgactttttcgtccaggttctggaaggtcaccgctgcgtaattatcggttccgaaatcgggcaggagaggaatatccgatttttccgtatcaataaaggtatttccgtcgaaggaacctacatagtactgtgtgatatgtgacatacggtcaaaggcgttattttccttccctgtttcttcgggaggcagtatcatgctgataataaggacccatttttccccatcctccgtctgcaggggaaagcagtcagggcattcgcagattccccccaggccatggattccggcctggaattcgcccgtcttttcccagtccttcagatttcgggagctgtaaaattccacattttttcctgccgcgagcaccaggctgtagcattgctttatggggttccagaagaccttggggtcgcggaagtcaggctggccttcgtttgctatgattggattcccgtaatacttttcaaaatgttcatagtccagactgtatgcaatgctttgctgctccagatgggtcgttgtattatggctggtataaacggctatcatcgggggattttcaaggcttccgaagccggacaggttttctttgtccagtacgcaggagcccgaaaagatacatcccagttcatcgggatacaaagcggtgggaagatgttcccagcggagcaaatcccgggtaacggcgtggccccaatgcatcggcccccagtagggggccgccggataatactggtaaaacagatggtatcggccgtttgcatatatcatgccgttaggatcattcatccagtttgccggaggggtaaaatgaacgacaggtctgtagttgttttttgtttgcattgttcagattatctcctttttatttttctgactatagtaatgcatggtataaagaatttattgtttttattatttgcggcttctgtcaacagctgactgataaatggataccagctcttccacacctgcggactgcagctcgccaaggtaagcattccagttatcatcggtaacgccgccggttacccactgattgatatatctgtcaacgatatcggaaatagtgggctgtatctgggcgagtctggacaattcactggtggtcatcataacacgggggattgtatcatattcttccatgatttcatctttgccgtttgttttctggttctcaagaagctgtacggcatcataggcgtaacctgcaacagtttcataatattcattcaggacgatcatggatccgcgtgtggtggtggaattcacacgggcttccccgaaggtggtgtactcggtctgcggctgatatcttccctgttcatcaagaggggttcttaaaataccgttttcatcctttacatagttatagccttcggcgccccagttggactggatggagatggcaggatcgcctaccatgtaatccacgaatttggctactacatgagggaatttacagctggtggtaatggcggtgttggaggaatcctgaagctcggaataattgttttcgaatccggtcattcctgcttcgccctgcagacggggaatggcaacgtattcgtcatgtacatccaggttcgtgatttcctgatcggtccaggtgccgaagcatccgattctggcgacctcttctttgattaaagaagatttataggatgcgctttcatccgcttcgaaggagccgttccagattaagccctcgttgtaaagcatgttgaagaattctgccgttttacggaaggcttcatcctgtgcggtaaaggtaaccttatcatcgatcagtctgaggtgatcggcatatgcgttgccgccgcagtaagagtctgcacagccgaaagcgccggtaaaacgatagaacatgttataggagccaaaggtatcggtagcaccgaaccaggtagccatggggatttcatcggcagcaccgttgccgttcaaatcgccgccgtcacggaaggccttcaggcagtcaacccattcatcaacagtggtgggtacttctttgccgacttcatccagccaggttttgttgatcagcagagggccgcctgtaagaacgaggccgtacatttcttctatgtaggggaaaccataggtgtgtccgtcgggagcggtaatttccgaccagtaattttcactgtcatcaaggattttcttcaggttgggcatatattcgttgataaggccttcggtaggcatgaagatatcctgatccgcatactgaacaacgatgttgccggatttgccgtcgccgaagctccagaatacatcgggaagctcttcaccggaagcgagcatcagattgattttttcctgtgcgccttcggaagggatggcctgccattcgaattcgataccggtatcttcaaaccataccttgcacatttccagatcctctacaggaacgactctgtctgcagagtttacaatcaaagcggaaattttgccgtatttggcttcaaaggcttccggatctttgatgatgggtagggtgccgtccaggctgataagccctgcgtccacggcttcctgttcctcctccgtcaggccgctgtcttcggctgaggaagcggctgccactgcttcttccaggttatcggttgtctggctgacagctcccgcatcggaagcgcctccggatgtggagccgcttccgcagccggagagaagtccgattgccattgtcagtgagatcagtaatgaaacgattttctttttcatgtgtgttcctccttaattttgga

SEQ ID NO: 30-31 - skipped (2 entries)

SEQ ID NO: 32 - DNA, 1522 bp, unidentified
  source 1..1522: mol_type = genomic DNA; note = Thomasclavelia sp000508865
atggagagtttgatcctggctcaggatgaacgctggcggcgtgcctaatacatgcaagtcgaacgcgggcagcaatgcccgagtggcgaacgggtgagtaatacataagtaacctgccctttacagggggataactattggaaacgatagctaagaccgcataggtaaagataccgcatggtaagtttattaaaagtgccaaggcactggtagaggatggacttatggcgcattagctagttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaggaaggtcttcggactgtaaacttctgttataaaggaagaaaggcggatacagggaatggtatccgagtgacggtactttatgaggaagccacggctaactacgtgccagcagccgcggtaatacgtaggtggcaagcgttatccggaattattgggcgtaaagagggagcaggcggcagcaagggtctgtggtgaaagactgaagcttaacttcagtaagccatagaaaccgggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttgggagtcaaatctcagtgctgcagttaacgcagtaagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagatatatgggatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtggagcgaaacccagaaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggagggagctgtctaaggtgggattgatgattggggtgaagtcgtaacaaggtatccctacgggaacgtggggatggatcacctccttt

SEQ ID NO: 33 - skipped

SEQ ID NO: 34 - DNA, 1530 bp, Flavonifractor plautii
  source 1..1530: mol_type = genomic DNA
tattgagagtttgatcctggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctccttt

SEQ ID NO: 35 - DNA, 1528 bp, unidentified
  source 1..1528: mol_type = genomic DNA; note = Hungatella effluvii
atgagagttcgatcctggctcaggatgaacgctggcggcgtgcttaacacatgcaagtcgagcgaagcggtttcaatgaagttttcggatggaattgaaattgacttagcggcggacgggtgagtaacgcgtgggtaacctgccttacactgggggataacagttagaaatgactgctaataccgcataagcgcacagggccgcatggtctggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaaagtccttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaatcatttaaccgtgatccctcttcggagcaatggagacaggtggtgcatggttgtcgtcagctcgtgtcgtgagatgttgggttaagtcccgcaacgagcgcaacccttatccttagtagccagcaagtaatgttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctccttt

SEQ ID NO: 36 - skipped

SEQ ID NO: 37 - DNA, 1529 bp, Blautia coccoides
  source 1..1529: mol_type = genomic DNA
tcagagagtttgatcctggctcaggatgaacgctggcggcgtgcttaacacatgcaagtcgagcgaagcactaagacggatttcttcggattgaagtctttgtgactgagcggcggacgggtgagtaacgcgtgggtaacctgcctcatacagggggataacagttagaaatgactgctaataccgcataagcgcacaggatcgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcacctccttt

SEQ ID NO: 38 - DNA, 1530 bp, unidentified
  source 1..1530: mol_type = genomic DNA; note = Enterocloster bolteae
atgagagtttgatcctggctcaggatgaacgctggcggcgtgcctaacacatgcaagtcgaacgaagcaattaaaatgaagttttcggatggatttttgattgactgagtggcggacgggtgagtaacgcgtggataacctgcctcacactgggggataacagttagaaatgactgctaataccgcataagcgcacagtaccgcatggtacggtgtgaaaaactccggtggtgtgggatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 39-43 - skipped (5 entries)

SEQ ID NO: 44 - DNA, 1521 bp, Anaerotruncus colihominis
  source 1..1521: mol_type = genomic DNA
caaagagtttgatcctggctcaggacgaacgctggcggcgcgcctaacacatgcaagtcgaacggagcttacgttttgaagttttcggatggatgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccgcaaggggggcgctgtcgaaggtgggattgatgactggggtgaagtcgtaacaaggtagccgtatcggaaggtgcggctggatcacctccttt

SEQ ID NO: 45 - DNA, 1528 bp, unidentified
  source 1..1528: mol_type = genomic DNA; note = Sellimonas intestinalis
acgagagtttgatcctggctcaggatgaacgctggcggcgtgcctaacacatgcaagtcgagcgaagcgctgttttcagaatcttcggaggaagaggacagtgactgagcggcggacgggtgagtaacgcgtgggcaacctgcctcatacagggggataacagttagaaatgactgctaataccgcataagcgcacaggaccgcatggtgtagtgtgaaaaactccggtggtatgagatggacccgcgtctgattaggtagttggtggggtaaaggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaagatgacggtacctgagtaagaagcaccggctaaatacgtgccagcagccgcggtaatacgtatggtgcaagcgttatccggatttactgggtgtaaagggagcgtagacggataggcaagtctggagtgaaaacccagggctcaaccctgggactgctttggaaactgcagatctggagtgccggagaggtaagcggaattcctagtgtagcggtgaaatgcgtagatattaggaggaacaccagtggcgaaggcggcttactggacggtgactgacgttgaggctcgaaagcgtggggagcaaacaggattagataccctggtagtccacgccgtaaacgatgactactaggtgtcggtgtgcaaagcacatcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctggtcttgacatccggatgacgggcgagtaatgtcgccgtcccttcggggcatccgagacaggtggtgcatggttgtcgtcagctcgtgtcgtgagatgttgggttaagtcccgcaacgagcgcaacccttatcttcagtagccagcatataaggtgggcactctggagagactgccagggagaacctggaggaaggtggggatgacgtcaaatcatcatgccccttatggccagggctacacacgtgctacaatggcgtaaacaaagggaagcgagagggtgacctggagcgaatcccaaaaataacgtctcagttcggattgtagtctgcaactcgactacatgaagctggaatcgctagtaatcgcggatcagcatgccgcggtgaatacgttcccgggtcttgtacacaccgcccgtcacaccatgggagtcagtaacgcccgaagccagtgacccaaccttagaggagggagctgtcgaaggcgggacggataactggggtgaagtcgtaacaaggtagccgtatcggaaggtgcggctggatcacctccttt

SEQ ID NO: 46 - DNA, 1527 bp, unidentified
  source 1..1527: mol_type = genomic DNA; note = Enterocloster asparagiformis
tttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctccttt

SEQ ID NO: 47 - DNA, 1527 bp, unidentified
  source 1..1527: mol_type = genomic DNA; note = Otoolea symbiosa
atgagagtttgatcctggctcaggatgaacgctggcggcgtgcctaacacatgcaagtcgaacgaagcgatttaacggaagttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctccttt

SEQ ID NO: 48 - skipped

SEQ ID NO: 49 - DNA, 1524 bp, unidentified
  source 1..1524: mol_type = genomic DNA; note = Thomasclavelia ramosa
atggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctccttt

SEQ ID NO: 50-51 - skipped (2 entries)

SEQ ID NO: 52 - DNA, 1530 bp, unidentified
  source 1..1530: mol_type = genomic DNA; note = Faecalicatena contorta
aacgagagtttgatcctggctcaggatgaacgctggcggcgtgcttaacacatgcaagtcgagcgaagcgctttacttagatttcttcggattgaaaagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 53-56 - skipped (4 entries)

SEQ ID NO: 57 - DNA, 1534 bp, unidentified
  source 1..1534: mol_type = genomic DNA; note = Clostridium_AP sp000509125
aacgagagtttgatcctggctcaggatgaacgctggcggcgtgcctaacacatgcaagtcgaacgaagcgcttccgctagattttcttcggagatgaaggcggctgcgactgagtggcggacgggtgagtaacgcgtgggcaacctgccttgcactgggggataacagccagaaatggctgctaataccgcataagaccgaagcgccgcatggcgcagcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtatgggagggagccgtcgaaggtgggaccgataactggggtgaagtcgtaacaaggtagccgtatcggaaggtgcggctggatcacctccttt

SEQ ID NO: 58 - DNA, 1527 bp, unidentified
  source 1..1527: mol_type = genomic DNA; note = Eisenbergiella porci
agagagtttgatcctggctcaggatgaacgctggcggcgtgcctaacacatgcaagtcgaacggagttatgcagaggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgtccgtaacggggcattctcttcggagcattggagacaggtggtgcatggttgtcgtcagctcgtgtcgtgagatgttgggttaagtcccgcaacgagcgcaacccttatccttagtagccagcaggtagagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgcaagggaggagcagtcgaaggcaggtctaataactggggtgaagtcgtaacaaggtagccgtatcggaaggtgcggctggatcacctccttt

SEQ ID NO: 59 - DNA, 1528 bp, unidentified
  source 1..1528: mol_type = genomic DNA; note = Enterocloster sp000155435
tttgagagtttgatcctggctcaggatgaacgctggcggcgtgcctaacacatgcaagtcgaacgaagcatcccataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggggagacaggtggtgcatggttgtcgtcagctcgtgtcgtgagatgttgggttaagtcccgcaacgagcgcaacccttatccttagtagccagcacctcgggtgggcactctagggagactgccagggataacctggaggaaggtggggatgacgtcaaatcatcatgccccttatgatttgggctacacacgtgctacaatggcgtaaacaaagggaagcggccctgcgaaggtgagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctccttt

SEQ ID NO: 60 - DNA, 1527 bp, unidentified
  source 1..1527: mol_type = genomic DNA; note = Eisenbergiella tayi
agagagtttgatcctggctcaggatgaacgctggcggcgtgcctaacacatgcaagtcgaacgaagttacacagaggaagttttcggatggaatcggtataacttagtggcggacgggtgagtaacgcgtgggaaacctgccctgtaccgggggataacacttagaaataggtgctaataccgcataagcgcacagcttcacatgaagcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgtcaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatcttgtaaaagagataggccttcgggacaggggagacaggtggtgcatggttgtcgtcagctcgtgtcgtgagatgttgggttaagtcccgcaacgagcgcaacccttattcttagtagccagcaggtaaggctgggcactctaaggagactgccggggataacccggaggaaggcggggatgacgtcaaatcatcatgccccttatgatttgggctacacacgtgctacaatggcgtaaacaaagggaagcgagacagcgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctccttt

SEQ ID NO: 61-110 - skipped (50 entries)

SEQ ID NO: 111 - DNA, 1530 bp, unidentified
  source 1..1530: mol_type = genomic DNA; note = Enterocloster bolteae
atgagagtttgatcctggctcaggatgaacgctggcggcgtgcctaacacatgcaagtcgaacgaagcaattaaaatgaagttttcggatggatttttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaggagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 112 - DNA, 1521 bp, Anaerotruncus colihominis; identical to SEQ ID NO: 44
  source 1..1521: mol_type = genomic DNA

SEQ ID NO: 113 - DNA, 1528 bp, unidentified; identical to SEQ ID NO: 45
  source 1..1528: mol_type = genomic DNA; note = Sellimonas intestinalis

SEQ ID NO: 114 - DNA, 1527 bp, unidentified
  source 1..1527: mol_type = genomic DNA; note = Otoolea symbiosa
atgagagtttgatcctggctcaggatgaacgctggcggcgtgcctaacacatgcaagtcgaacgaagcgatttaacggaagttttcggatggaagttggattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctccttt

SEQ ID NO: 115 - DNA, 1530 bp, unidentified
  source 1..1530: mol_type = genomic DNA; note = Blautia celeris
tcagagagtttgatcctggctcaggatgaacgctggcggcgtgcttaacacatgcaagtcgagcgaagcacttaagtggatctcttcggattgaaacttatttgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacatcagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcctagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttacaggagggagctgccgaaggcgggaccgataactggggtgaagtcgtaacaaggtagccgtatcggaaggtgcggctggatcacctccttt

SEQ ID NO: 116 - DNA, 1529 bp, Dorea longicatena
  source 1..1529: mol_type = genomic DNA
aacgagagtttgatcctggctcaggatgaacgctggcggcgtgcttaacacatgcaagtcgagcgaagcactttggaaagattcttcggatgatttcctttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 117 - DNA, 1537 bp, Clostridium innocuum
  source 1..1537: mol_type = genomic DNA
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgcaaggagtgagccgtcgaaggtaggaccgatgactggggttaagtcgtaacaaggtatccctacgggaacgtggggatggatcacctccttt

SEQ ID NO: 118 - DNA, 1530 bp, Flavonifractor plautii; identical to SEQ ID NO: 34
  source 1..1530: mol_type = genomic DNA
